US012163125B2

(12) United States Patent
Vijayakumar et al.

(10) Patent No.: US 12,163,125 B2
(45) Date of Patent: *Dec. 10, 2024

(54) ENGINEERED CLASS 2 TYPE V CRISPR SYSTEMS

(71) Applicant: Scribe Therapeutics Inc., Alameda, CA (US)

(72) Inventors: Gayathri Vijayakumar, Oakland, CA (US); Sean Higgins, Alameda, CA (US); Isabel Colin, Oakland, CA (US); Sarah Denny, San Francisco, CA (US); Brett T. Staahl, Tiburon, CA (US); Benjamin Oakes, El Cerrito, CA (US); Angus Sidore, Oakland, CA (US); Suraj Makhija, San Francisco, CA (US)

(73) Assignee: Scribe Therapeutics Inc., Alameda, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/572,208

(22) Filed: Jan. 10, 2022

(65) Prior Publication Data

US 2023/0054437 A1  Feb. 23, 2023

Related U.S. Application Data

(63) Continuation of application No. PCT/US2021/061673, filed on Dec. 2, 2021.

(60) Provisional application No. 63/208,855, filed on Jun. 9, 2021, provisional application No. 63/162,346, filed on Mar. 17, 2021, provisional application No. 63/121,196, filed on Dec. 3, 2020.

(51) Int. Cl.
| *C12N 15/10* | (2006.01) |
| *C12N 9/22* | (2006.01) |
| *C12N 15/11* | (2006.01) |
| *C12N 15/113* | (2010.01) |
| *C12N 15/85* | (2006.01) |
| *C12N 15/86* | (2006.01) |
| *C12N 15/90* | (2006.01) |

(52) U.S. Cl.
CPC ............ *C12N 15/102* (2013.01); *C12N 9/22* (2013.01); *C12N 15/11* (2013.01); *C12N 15/111* (2013.01); *C12N 15/113* (2013.01); *C12N 15/85* (2013.01); *C12N 15/86* (2013.01); *C12N 15/907* (2013.01); *C12N 2310/20* (2017.05); *C12N 2320/50* (2013.01); *C12N 2750/14143* (2013.01); *C12N 2800/80* (2013.01)

(58) Field of Classification Search
None
See application file for complete search history.

(56) References Cited

U.S. PATENT DOCUMENTS

| 5,208,036 | A | 5/1993 | Eppstein et al. |
| 5,264,618 | A | 11/1993 | Felgner et al. |
| 5,279,833 | A | 1/1994 | Rose |
| 5,283,185 | A | 2/1994 | Epand et al. |
| 5,405,783 | A | 4/1995 | Pirrung et al. |
| 5,412,087 | A | 5/1995 | Mcgall et al. |
| 5,445,934 | A | 8/1995 | Fodor et al. |
| 5,695,937 | A | 12/1997 | Kinzler et al. |
| 5,753,613 | A | 5/1998 | Ansell et al. |
| 5,785,992 | A | 7/1998 | Ansell et al. |
| 6,979,538 | B2 | 12/2005 | Ladner et al. |
| 9,738,593 | B2 | 8/2017 | Ansell et al. |
| 9,982,267 | B2 | 5/2018 | Del'Guldice et al. |
| 10,106,490 | B2 | 10/2018 | Du |
| 10,166,298 | B2 | 1/2019 | Ansell et al. |
| 10,221,127 | B2 | 3/2019 | Du et al. |
| 10,253,365 | B1 | 4/2019 | Doudna et al. |
| 10,337,001 | B2 | 7/2019 | Ryan et al. |
| 10,570,415 | B2 | 2/2020 | Doudna et al. |
| 11,219,634 | B2 | 1/2022 | Prieve et al. |
| 11,535,835 | B1 | 12/2022 | Oakes et al. |
| 11,560,555 | B2 | 1/2023 | Oakes et al. |
| 11,613,742 | B2 | 3/2023 | Oakes et al. |
| 11,795,472 | B2 | 10/2023 | Doudna et al. |
| 11,873,504 | B2 | 1/2024 | Doudna et al. |
| 2006/0083780 | A1 | 4/2006 | Heyes et al. |
| 2006/0240554 | A1 | 10/2006 | Chen et al. |
| 2011/0071208 | A1 | 3/2011 | Maclachlan et al. |
| 2011/0076335 | A1 | 3/2011 | Yaworski et al. |
| 2011/0117125 | A1 | 5/2011 | Hope et al. |
| 2014/0068797 | A1 | 3/2014 | Doudna et al. |
| 2014/0273226 | A1 | 9/2014 | Wu |
| 2016/0208243 | A1 | 7/2016 | Zhang et al. |
| 2017/0211142 | A1 | 7/2017 | Smargon et al. |
| 2017/0233756 | A1 | 8/2017 | Begemann et al. |
| 2017/0321198 | A1 | 11/2017 | Severinov et al. |

(Continued)

FOREIGN PATENT DOCUMENTS

| WO | WO-96/10390 A1 | 4/1996 |
| WO | WO-2009/127060 A1 | 10/2009 |

(Continued)

OTHER PUBLICATIONS

Koonin, E.V. et al. (2019). "Origins and evolution of CRISPR-Cas systems," Philos. Trans. R. Soc. Lond. Biol. Sci. 374:20180087.
Makarova, K.S. et al. (2020). "Evolutionary classification of CRISPR-Cas systems: a burst of class 2 and derived variants," Nature Reviews Microbiology 18:67-83.
NCBI Reference Sequence, priority to Oct. 21, 2016, OHA03494.1, hypothetical protein A3J58_03210 [Candidatus Sungbacteria bacterium RIFCSPHIGHO2_02_FULL_52_23], 2 pages.

(Continued)

*Primary Examiner* — Nancy J Leith
(74) *Attorney, Agent, or Firm* — Cooley LLP

(57) ABSTRACT

Provided herein are engineered Class 2, Type V nucleases and guide RNAs useful for the editing of target nucleic acids. Also provided are methods of making and using such variants to modify nucleic acids.

28 Claims, 60 Drawing Sheets

Specification includes a Sequence Listing.

(56) References Cited

U.S. PATENT DOCUMENTS

| | | |
|---|---|---|
| 2017/0369870 A1 | 12/2017 | Gill et al. |
| 2018/0258424 A1 | 9/2018 | Greenberg |
| 2018/0346927 A1 | 12/2018 | Doudna et al. |
| 2018/0363009 A1 | 12/2018 | Doudna et al. |
| 2019/0276842 A1 | 9/2019 | Doudna et al. |
| 2019/0336608 A1 | 11/2019 | Baumhof et al. |
| 2019/0359973 A1 | 11/2019 | Kmiec et al. |
| 2019/0381180 A1 | 12/2019 | Baumhof et al. |
| 2020/0017879 A1 | 1/2020 | Doudna et al. |
| 2020/0121809 A1 | 4/2020 | Hope et al. |
| 2020/0224160 A1 | 7/2020 | Ding et al. |
| 2020/0407738 A1 | 12/2020 | Nagy |
| 2021/0115420 A1 | 4/2021 | Bauer et al. |
| 2021/0139892 A1 | 5/2021 | Wilson et al. |
| 2021/0166783 A1 | 6/2021 | Shmakov et al. |
| 2021/0284981 A1 | 9/2021 | Doudna et al. |
| 2021/0309981 A1 | 10/2021 | Doudna et al. |
| 2022/0081681 A1 | 3/2022 | Oakes et al. |
| 2022/0090036 A1 | 3/2022 | Oakes et al. |
| 2022/0177872 A1 | 6/2022 | Oakes et al. |
| 2022/0220508 A1 | 7/2022 | Oakes et al. |
| 2022/0348925 A1 | 11/2022 | Oakes et al. |
| 2023/0032369 A1 | 2/2023 | Oakes et al. |
| 2023/0033866 A1 | 2/2023 | Oakes et al. |
| 2023/0081117 A1 | 3/2023 | Oakes et al. |
| 2023/0124880 A1 | 4/2023 | Oakes et al. |
| 2023/0167424 A1 | 6/2023 | Oakes et al. |
| 2024/0026385 A1 | 1/2024 | Vijayakumar et al. |

FOREIGN PATENT DOCUMENTS

| | | |
|---|---|---|
| WO | WO-2010/054007 A1 | 5/2010 |
| WO | WO-2010/075303 A1 | 7/2010 |
| WO | WO-2012/068627 A1 | 5/2012 |
| WO | WO-2017/106569 A1 | 6/2017 |
| WO | WO-2018/064371 A1 | 4/2018 |
| WO | WO-2018/152418 A1 | 8/2018 |
| WO | WO-2018/172556 A1 | 9/2018 |
| WO | WO-2018/195555 A1 | 10/2018 |
| WO | WO-2019/084148 A1 | 5/2019 |
| WO | WO-2019/168950 A1 | 9/2019 |
| WO | WO-2020/023529 A1 | 1/2020 |
| WO | WO-2020/041456 A1 | 2/2020 |
| WO | WO-2020/247882 A1 | 12/2020 |
| WO | WO-2020/247883 A2 | 12/2020 |
| WO | WO-2020/247883 A3 | 12/2020 |
| WO | WO-2021/007177 A1 | 1/2021 |
| WO | WO-2021/025999 A1 | 2/2021 |
| WO | WO-2021/050601 A1 | 3/2021 |
| WO | WO-2021/084533 A1 | 5/2021 |
| WO | WO-2021/113769 A1 | 6/2021 |
| WO | WO-2021/113772 A1 | 6/2021 |
| WO | WO-2021/188729 A1 | 9/2021 |
| WO | WO-2022/119957 A1 | 6/2022 |
| WO | WO-2022/120095 A1 | 6/2022 |
| WO | WO-2022/200858 A1 | 9/2022 |
| WO | WO-2022/261150 A2 | 12/2022 |
| WO | WO-2022/261150 A3 | 12/2022 |
| WO | WO-2023/049742 A2 | 3/2023 |
| WO | WO-2023/049872 A2 | 3/2023 |
| WO | WO-2023/049872 A3 | 3/2023 |
| WO | WO-2023/235818 A2 | 12/2023 |

OTHER PUBLICATIONS

Notice of Allowance dated Sep. 13, 2022, for U.S. Appl. No. 17/533,997, filed Nov. 23, 2021, 9 pages.
Shmakov, S. et al. (2017). "Diversity and evolution of class 2 CRISPR-Cas Systems," Nature Reviews Microbiology 15:169-182.
Stella, S. et al. (2017). "Class 2 CRISPR-Cas RNA-guided endonucleases: Swiss Army knives of genome editing," Nature Structural and Molecular Biology 24:882-892.
Yang, H. et al. (2017). "New CRISPR-Cas systems discovered," Cell Res. 27:313-314.
U.S. Appl. No. 17/641,404, filed Sep. 9, 2020, by Oakes et al. (Copy not attached).
U.S. Appl. No. 17/791,130, filed Jan. 8, 2021, by Oakes et al. (Copy not attached).
U.S. Appl. No. 18/051,815, filed Nov. 1, 2022, by Oakes et al. (Copy not attached).
U.S. Appl. No. 17/828,957, filed Dec. 4, 2020, by Oakes et al. (Copy not attached).
U.S. Appl. No. 17/932,798, filed Mar. 17, 2021, by Oakes et al. (Copy not attached).
U.S. Appl. No. 18/168,426, filed Feb. 13, 2023, by Oakes et al. (Copy not attached).
U.S. Appl. No. 18/058,251, filed Nov. 22, 2022, by Oakes et al. (Copy not attached).
Aguilera, T.A. et al. (Jun. 2009). "Systemic in vivo distribution of activatable cell penetrating peptides is superior to that of cell penetrating peptides," Integr. Biol. (Camb) 1(5-6):371-381. Published online May 11, 2009.
Altschul, S.F. et al. (Oct. 1990). "Basic local alignment search tool," J. Mol. Biol. 215:403-410.
Buenrostro, J.D. et al. (2014). "Quantitative analysis of RNA-protein interactions on a massively parallel array reveals biophysical and evolutionary landscapes," Nat. Biotechnol. 32:562-568, 19 pages provided.
Burstein, D. et al. (Feb. 2017). "New CRISPR-Cas systems from uncultivated microbes," Nature 542:237-241. with Supplemental Materials, 28 total pages.
Chen, B. et al. (Dec. 2003). "Influence of histidine on the stability and physical properties of a fully human antibody in aqueous and solid forms," Pharm. Res. 20:1952-1960.
Ghirlando, R. et al. (May 1999). "Glycosylation of human IgG-Fc: influences on structure revealed by differential scanning microcalorimetry," Immunil Letters 68:47-52.
International Search Report dated Nov. 10, 2020, for PCT Application No. PCT/US2020/036505, filed on Jun. 5, 2020, 8 pages.
International Search Report dated Nov. 24, 2020, for PCT Application No. PCT/US2020/036506, filed on Jun. 5, 2020, 5 pages.
International Search Report dated Mar. 30, 2022, for PCT Application No. PCT/US2021/061673, filed on Dec. 2, 2021, 6 pages.
Jarmoskaite, I. et al. (Jun. 2019). "A quantitative and predictive model for RNA binding by human pumilio proteins," Molecular Cell 74:966-981, 65 pages provided. Published online May 8, 2019.
Kiyama, R. et al. (Nov. 1996). "In vitro transcription of a poly(dA)-poly(dT)-containing sequence is inhibited by interaction between the template and its transcripts," Nucleic Acids Research 24:4577.
Kotin, R.M. (Jul. 1994). "Prospects for the use of adeno-associated virus as a vector for human gene therapy," Human Gene Therapy 5:793-801.
Liu, J.J. et al. (Feb. 2019). "CasX enzymes comprise a distinct family of RNA-guided genome leditors," Nature 566:218-223. Published online Feb. 4, 2019, 38 pages provided.
Liu, J.J. et al. CasX enzymes comprise a distinct family of RNA-guided genome editors, Nature 568:E8-E10. (Author correction: published online Apr. 3, 2019).
Lorenz, R. et al. (Nov. 2011). "ViennaRNA Package 2.0," Algorithms for Molecular Biology 6:26, 14 pages. Published online Nov. 24, 2011.
Maeder, M.L. et al. (2019). "Development of a gene-editing approach to restore vision loss in Leber congenital amaurosis type 10," Nature Medicine 25:229-233. Published online Jan. 21, 2019.
Murray, A. et al. (Jul. 2002). "Epitope affinity chromatography and biophysical studies of monoclonal antibodies and recombinant antibody fragments," J. Chromatogr. Sci. 40:343-349.
Noguchi, H. et al. (Jul. 2003). "PDX-1 protein containing its own antennapedia-like protein transduction domain can transduce pancreatic duct and islet cells," Diabetes 52:1732-1737.
Non-Final Office Action dated May 19, 2022, for U.S. Appl. No. 17/533,997, filed Nov. 23, 2021, 27 pages.
Oakes, B.L. et al. (Jun. 2016). "Profiling of engineering hotspots identifies an allosteric CRISPR-Cas9 switch," Nat. Biotechnol. 34:646-651, 14 pages provided. Published online May 2, 2016.

(56) References Cited

OTHER PUBLICATIONS

Qi, L.S. et al. (Feb. 2013). "Repurposing CRISPR as an RNA-guided platform for sequence-specific control of gene expression," Cell 152:1173-1183, 22 pages provided.
Smith, T.F. et al. (1981). "Comparison of biosequences," Adv. Appl. Math. 2:482-489.
Tréhin, R. et al. (Jul. 2004). "Cellular uptake but low permeation of human calcitonin-derived cell penetrating peptides and Tat(47-57) through well-differentiated epithelial models," Pharm. Res. 21:1248-1256.
Tuerk, C. et al. (Mar. 1988). "CUUCGG hairpins: extraordinarily stable RNA secondary structures associated with various biochemical processes," PNAS 85:1364-1368.
Wender, P.A. et al. (Nov. 2000). "The design, synthesis, and evaluation of molecules that enable or enhance cellular uptake: peptoid molecular transporters," PNAS 97:13003-13008.
Written Opinion of the International Searching Authority dated Nov. 10, 2020, for PCT Application No. PCT/US2020/036505, filed on Jun. 5, 2020, 19 pages.
Written Opinion of the International Searching Authority dated Nov. 24, 2020, for PCT Application No. PCT/US2020/036506, filed on Jun. 5, 2020, 8 pages.
Written Opinion of the International Searching Authority dated Mar. 30, 2022, for PCT Application No. PCT/US2021/061673, filed on Dec. 2, 2021, 11 pages.
Yang, H. et al. (May 2019). "CasX: a new and small CRISPR gene-editing protein," Cell Res. 29:345- 346. Published online Apr. 16, 2019.
Yang, H. et al. (2016). "PAM-dependent target DNA recognition and cleavage by C2c1 CRISPR-Cas endonuclease," Cell 167:1814-1828, 31 pages provided.
Zender, L. et al. (Jun. 2002). "VP22-mediated intercellular transport of p53 in hepatoma cells in vitro and in vivo," Cancer Gene Ther. 9:489-496.
Zhang, J. et al. (Jun. 1997). "PowerBLAST: a new network BLAST application for interactive or automated sequence analysis and annotation," Genome Res. 7:649-656.
Zhao, H. et al. (Mar. 1998). "Molecular evolution by staggered extension process (StEP) in vitro recombination," Nature Biotechnol. 16:258-261.
Basilia, M. et al. (2017). "Minimal 2'-O-methyl phosphorothioate linkage modification pattern of synthetic guide RNAs for increased stability and efficient CRISPR-Cas9 gene editing avoiding cellular toxicity," PLoS One 12:e0188593, 19 total pages.
Biswas, N. et al. (2020). "Coupling-based convergence assessment of some Gibbs samplers for high-dimensional Bayesian regression with shrinkage priors," arXiv:2012.04798, 61 total pages.

Biswas, S. et al. (2021). "Low-N protein engineering with data-efficient deep learning," Nat. Methods 18:389-396.
Faust, S.M. et al. (2013). "CpG-depleted adeno-associated virus vectors evade immune detection," J. Clin. Invest. 123:2994-3001.
Foust, K.D. et al. (2013). "Therapeutic AAV9-mediated suppression of mutant SOD1 slows disease progression and extends survival in models of inherited ALS," Mol Ther. 21:2148-2159.
Maervoet, V.E.T. et al. (2017). "Synthetic biology of modular proteins," Bioengineered 8:196-202.
Merten, O-W. et al. (2016). "Towards routine manufacturing of gene therapy drugs," Mol. Ther. Methods Clin. Dev. 3:16021.
Roth, M.O. et al. (2022). "X" marks the spot: Mining the gold in CasX for gene editing, Mol. Cell. 82:1083-1085.
Selkova, P. et al. (2020). "Position of deltaaproteobacteria Cas12e nuclease cleavage sites depends on spacer length of guide RNA," RNA Biol. 17:1472-1479.
Tsuchida, C.A. et al. (2022). "Chimeric CRISPR-CasX enzymes and guide RNAs for improved genome editing activity," Mol Cell. 82:1199-1209.
U.S. Appl. No. 18/193,571, filed Mar. 30, 2023, by Oakes et al. (Copy not attached).
U.S. Appl. No. 18/466,636, filed Sep. 13, 2023, by Oakes et al. (Copy not attached).
Fowler, D.M. et al. (2014). "Measuring the activity of protein variants on a large scale using deep mutational scanning." Nature Protocols 9:2267-2284.
Moon, S.B. et al. (2019). "Improving CRISPR Genome Editing by Engineering Guide RNAs," Trends in Biotechnology 37:870-881.
Non-Final Office Action dated Dec. 1, 2023, for U.S. Appl. No. 18/058,251, filed Nov. 22, 2022, 17 pages.
Yin, H. et al. (2018). "Partial DNA-guided Cas9 enables genome editing with reduced off-target activity," Nature Chemical Biology 14:311-316, with Supplemental Materials, 18 total pages.
U.S. Appl. No. 18/538,885, filed Dec. 13, 2023, by Oakes et al. (Copy not attached).
Final Office Action mailed on Mar. 7, 2024, for U.S. Appl. No. 18/058,251, filed Nov. 22, 2022, 8 pages.
International Search Report mailed on Jan. 30, 2024, for PCT Application No. PCT/US2023,067791, filed on Jun. 1, 2023, 10 pages.
Notice of Allowance mailed on May 24, 2024, for U.S. Appl. No. 18/058,251, filed Nov. 22, 2022, 12 pages.
Written Opinion of the International Searching Authority mailed on Jan. 30, 2024, for PCT Application No. PCT/US2023/067791, filed on Jun. 1, 2023, 18 pages.
U.S. Appl. No. 18/663,845, filed May 14, 2024, by Vijayakumar et al.
U.S. Appl. No. 18/667,609, filed May 17, 2024, by Oakes et al.

Cleavage rate on NTC PAMs
FIG. 10A TTC
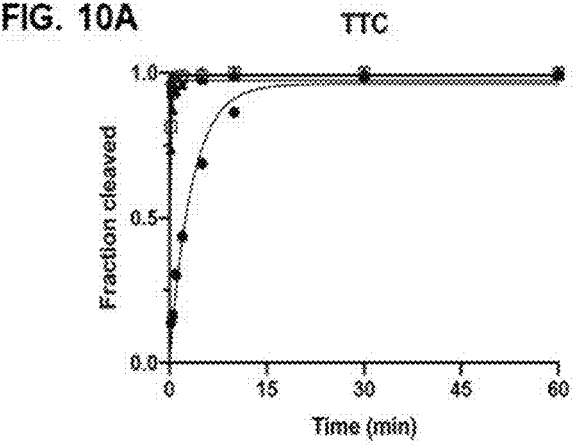
FIG. 10B CTC
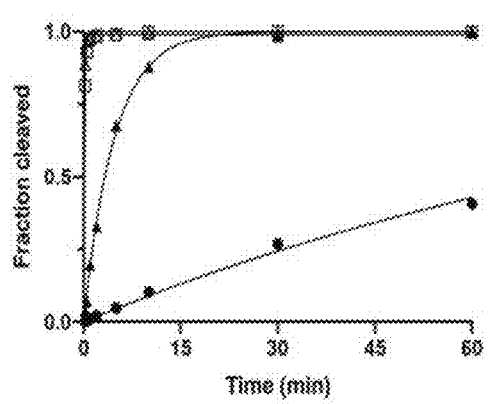
FIG. 10C GTC
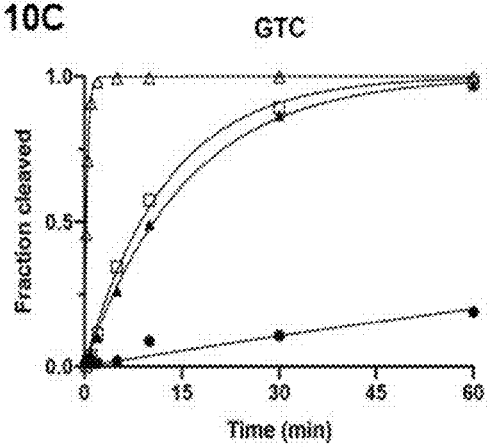
FIG. 10D ATC
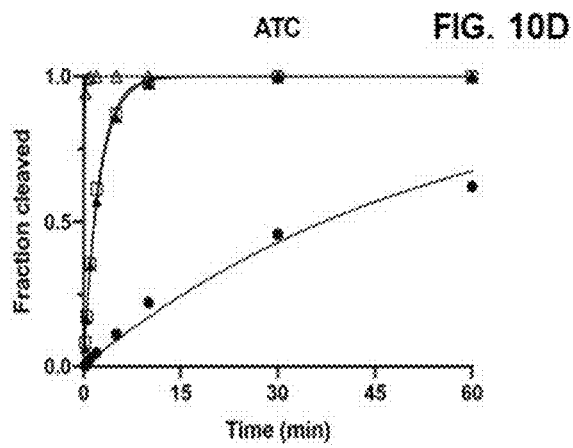
- 2
- 438
- 119
- 491

Methods of Generating CasX Protein and guide RNA Variants

Ribonucleotides 1-9 of SEQ ID NO: 2239    Ribonucleotides 27-35 of SEQ ID NO: 2239

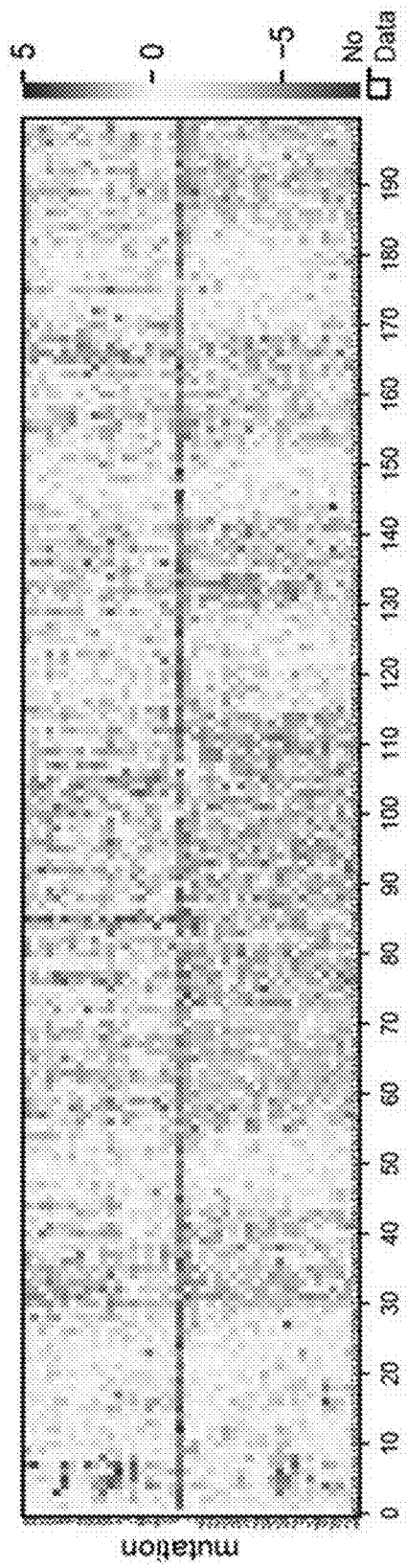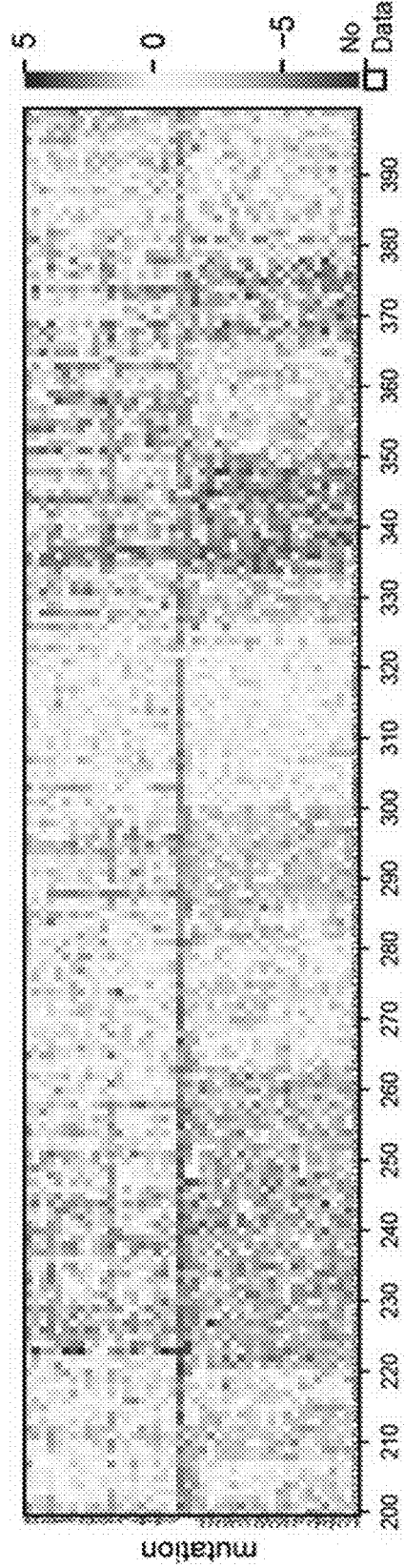
FIG. 35A
FIG. 35B

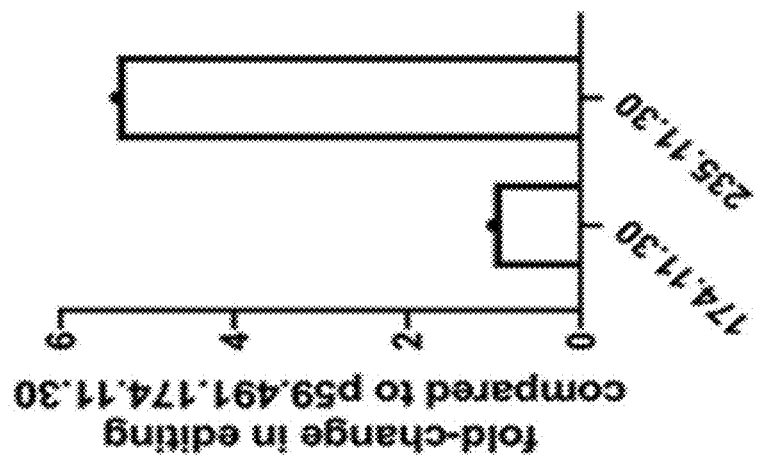
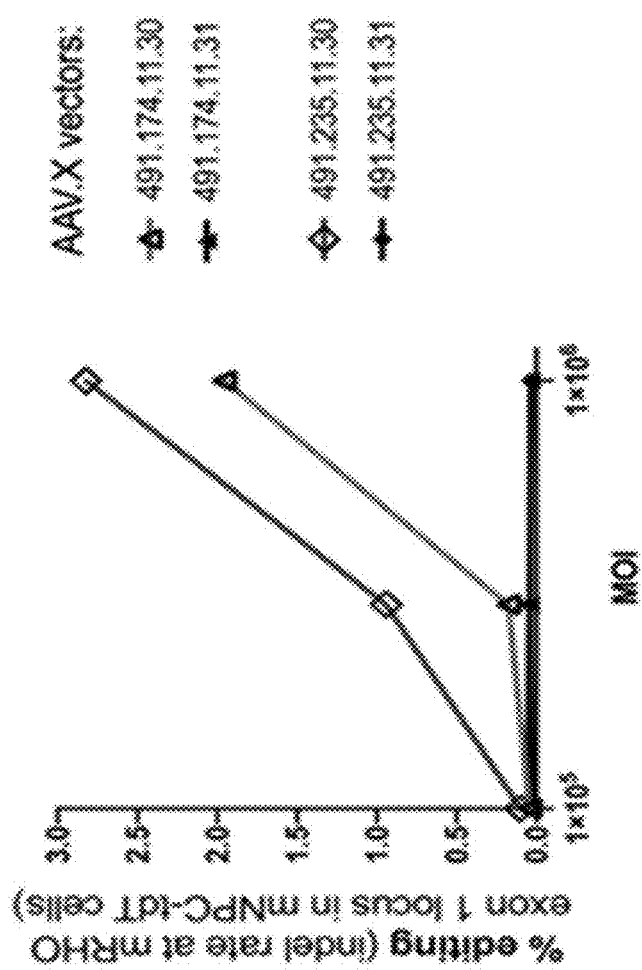
FIG. 45A
FIG. 45B extended stemloop:
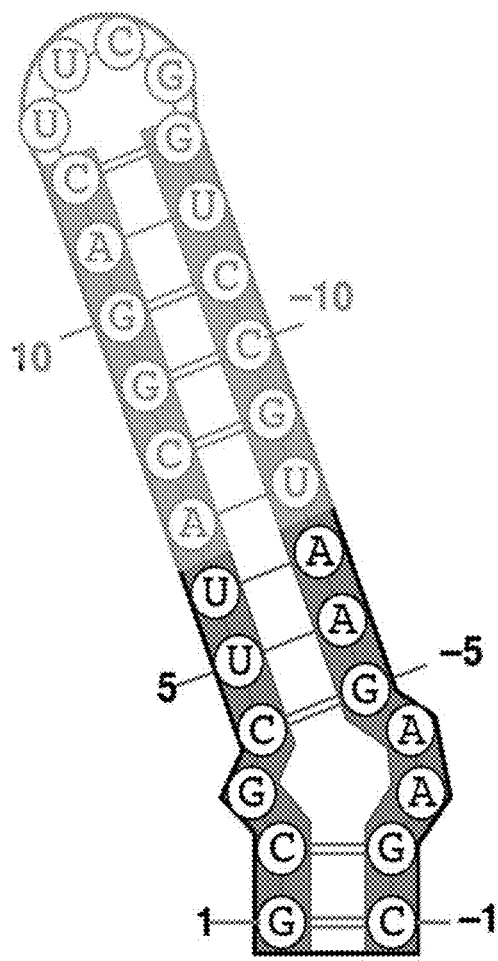 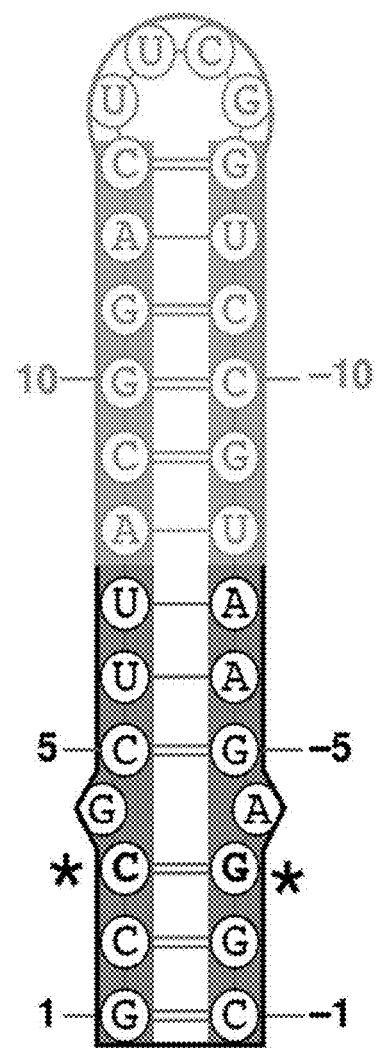
FIG. 46

ENGINEERED CLASS 2 TYPE V CRISPR SYSTEMS

CROSS-REFERENCE TO RELATED APPLICATIONS

This application is a continuation of International Patent Application No. PCT/US2021/061673, filed Dec. 2, 2021, which claims priority to U.S. Provisional Patent Application Nos. 63/121,196, filed Dec. 3, 2020, 63/162,346, filed on Mar. 17, 2021, and 63/208,855, filed Jun. 9, 2021, the contents of each of which are incorporated by reference in their entirety herein.

INCORPORATION BY REFERENCE OF SEQUENCE LISTING

The contents of the text file submitted electronically herewith are incorporated herein by reference in their entirety: A computer readable format copy of the Sequence Listing (filename: SCRB_031_03US_SeqList_ST25, date created: Sep. 10, 2024, file size 5,885,410 bytes).

BACKGROUND

The CRISPR-Cas systems of bacteria and archaea confer a form of acquired immunity against phage and viruses. Intensive research over the past decade has uncovered the biochemistry of these systems. CRISPR-Cas systems consist of Cas proteins, which are involved in acquisition, targeting and cleavage of foreign DNA or RNA, and a CRISPR array, which includes direct repeats flanking short spacer sequences that guide Cas proteins to their targets. Class 2 CRISPR-Cas are streamlined versions in which a single Cas protein bound to RNA is responsible for binding to and cleavage of a targeted sequence. The programmable nature of these minimal systems has facilitated their use as a versatile technology that is revolutionizing the field of genome manipulation.

To date, only a few Class 2 CRISPR/Cas systems have been discovered that have been widely used. Of these, Type V are unique in that they utilize a single unified RuvC-like endonuclease (RuvC) domain that recognizes 5' PAM sequences that are different from the 3' PAM sequences recognized by Cas9, and form a staggered cleavage in the target nucleic acid with 5, 7, or 10 nt 5' overhangs (Yang et al., PAM-dependent target DNA recognition and cleavage by C2c1 CRISPR-Cas endonuclease. Cell 167:1814 (2016)). However, Type V wild-type Cas and guide sequences have low editing efficiency. Thus, there is a need in the art for additional Class 2, Type V CRISPR/Cas systems (e.g., Cas protein plus guide RNA combinations) that have been optimized and/or offer improvements over earlier generation systems for utilization in a variety of therapeutic, diagnostic, and research applications.

SUMMARY

The present disclosure relates to guide ribonucleic acids (gRNA), engineered Class 2, Type V CRISPR proteins, and systems of engineered Class 2, Type V CRISPR proteins and guide ribonucleic acids (gRNA) used to modify a target nucleic acid of a gene in eukaryotic cells. In some embodiments, the present disclosure provides engineered Class 2, Type V proteins comprising one or more modifications relative to a domain of the reference CasX and exhibits one or more improved characteristics as compared to the reference CasX protein of SEQ ID NO: 2. In other embodiments, the present disclosure provides engineered sequence variants of a CasX variant protein, such as CasX 491 (SEQ ID NO: 336) or CasX 515 (SEQ ID NO: 416), wherein the Class 2, Type V protein comprises at least one modification relative to a domain of the CasX variant and exhibits one or more improved characteristics as compared to the CasX variant protein. In some embodiments, the Class 2, Type V variant is capable of forming a complex with a guide ribonucleic acid (gRNA), wherein the complex can bind and cleave a target nucleic acid, wherein the target nucleic acid comprises a non-target strand and a target strand.

In some embodiments, the present disclosure provides guide ribonucleic acids (gRNAs), including single-guide compositions, capable of binding a Class 2, Type V variant protein, wherein the gRNA comprises at least one modification in a region compared to the gRNA of SEQ ID NO: 2238 or SEQ ID NO: 2239. In some embodiments, the modified regions of the scaffold of the gRNA include: (a) an extended stem loop; (b) a scaffold stem loop; (c) a triplex; and (d) pseudoknot. In some cases, the scaffold extended stem of the variant gRNA further comprises a modification to the bubble. In other cases, the scaffold of the gRNA further comprises a modification to the triplex loop region. In other cases, the scaffold of the variant gRNA further comprises a heterologous RNA in the extended stem, including hairpin sequences.

In some embodiments, the present disclosure provides gene editing pairs comprising the engineered Class 2, Type V proteins and gRNA variants of any of the embodiments described herein, wherein the gene editing pair exhibits at least one improved characteristic as compared to a gene editing pair comprising a reference CasX protein of SEQ ID NO:1, SEQ ID NO:2, or SEQ ID NO:3 and a gRNA of SEQ ID NO: 4 or SEQ ID NO: 5. In a particular embodiment, the engineered Class 2, Type V protein comprises a sequence selected from the group consisting of the sequences of SEQ ID NOS: 247-592 and 1147-1231 as set forth in Table 3, or a sequence having at least about 85%, at least about 90%, or at least about 95%, or at least about 95%, or at least about 96%, or at least about 97%, or at least about 98%, or at least about 99% sequence identity thereto and the gRNA is a sequence selected from the group consisting of the sequences of SEQ ID NOS: 2101-2332 and 2353-2398 as set forth in Table 2, or a sequence having at least about 85%, at least about 90%, or at least about 95%, or at least about 95%, or at least about 96%, or at least about 97%, or at least about 98%, or at least about 99% sequence identity thereto. In a particular embodiment, the engineered Class 2, Type V protein comprises a sequence selected from the group consisting of the sequences of SEQ ID NOS: 270-592 and 1147-1231, or a sequence having at least about 85%, at least about 90%, or at least about 95%, or at least about 95%, or at least about 96%, or at least about 97%, or at least about 98%, or at least about 99% sequence identity thereto and the gRNA is a sequence selected from the group consisting of the sequences of SEQ ID NOS: 2238-2332 and 2353-2398, or a sequence having at least about 85%, at least about 90%, or at least about 95%, or at least about 95%, or at least about 96%, or at least about 97%, or at least about 98%, or at least about 99% sequence identity thereto. In a particular embodiment, the engineered Class 2, Type V protein comprises a sequence selected from the group consisting of the sequences of SEQ ID NOS: 415-592 and 1147-1231, or a sequence having at least about 85%, at least about 90%, or at least about 95%, or at least about 95%, or at least about 96%, or at least about 97%, or at least about 98%, or at least about 99% sequence identity thereto and the gRNA is a sequence selected from the group consisting of the sequences of SEQ ID NOS: 2281-2332 and 2353-2398, or a sequence having at least about 85%, at least about 90%, or at least about 95%, or at least about 95%, or at least about 96%, or at least about 97%, or at least about 98%, or at least about 99% sequence identity thereto.

In some embodiments, the present disclosure provides polynucleotides and vectors encoding the engineered Class 2, Type V variant proteins, gRNA variants and gene editing pairs described herein. In some embodiments, the vectors are viral vectors such as an Adeno-Associated Viral (AAV) vector. In other embodiments, the vectors are CasX delivery particles termed XDP that comprise RNPs of the gene editing pairs.

In some embodiments, the present disclosure provides cells comprising the polynucleotides, vectors, engineered Class 2, Type V proteins and gRNAs described herein. In other embodiments, the present disclosure provides cells comprising target nucleic acid edited by the methods of editing embodiments described herein.

In some embodiments, the present disclosure provides kits comprising the polynucleotides, vectors, engineered Class 2, Type V proteins, gRNAs and gene editing pairs described herein.

In some embodiments, the present disclosure provides methods of editing a target nucleic acid, comprising contacting the target nucleic acid with the Class 2, Type V protein and the gRNA variant described herein, wherein the contacting results in editing or modification of the target nucleic acid.

In some embodiments, the present disclosure provides methods of editing a target nucleic acid in a population of cells, comprising contacting the cells with one or more of the gene editing pairs described herein, wherein the contacting results in editing or modification of the target nucleic acid in the population of cells.

In other embodiments, the disclosure provides methods of treatment of a subject in need thereof, comprising administration of the gene editing pairs or vectors comprising or encoding the gene editing pairs of any of the embodiments described herein.

In another aspect, provided herein are gene editing pairs, compositions comprising gene editing pairs, or vectors comprising or encoding gene editing pairs, for use as a medicament.

In another aspect, provided herein are gene editing pairs, compositions comprising gene editing pairs, or vectors comprising or encoding gene editing pairs, for use in a method of treatment, wherein the method comprises editing or modifying a target nucleic acid; optionally wherein the editing occurs in a subject having a mutation in an allele of a gene wherein the mutation causes a disease or disorder in the subject, preferably wherein the editing changes the mutation to a wild type allele of the gene or knocks down or knocks out an allele of a gene causing a disease or disorder in the subject.

INCORPORATION BY REFERENCE

All publications, patents, and patent applications mentioned in this specification are herein incorporated by reference to the same extent as if each individual publication, patent, or patent application was specifically and individually indicated to be incorporated by reference. The contents of WO 2020/247882, WO 2020/247883, and WO 2021/113772, which disclose CasX variants and gRNA variants, and methods of delivering same, are hereby incorporated by reference in their entirety.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 10A shows the quantification of cleavage rates of CasX variants on TTC PAM, as described in Example 5. Target DNA substrates with identical spacers and the indicated PAM sequence were incubated with a 20-fold excess of the indicated RNP at 37° C. and the amount of cleaved target was determined at the indicated time points. Monophasic fit of a single replicate is shown.

FIG. 10B shows the quantification of cleavage rates of CasX variants on CTC PAM, as described in Example 5. Target DNA substrates with identical spacers and the indicated PAM sequence were incubated with a 20-fold excess of the indicated RNP at 37° C. and the amount of cleaved target was determined at the indicated time points. Monophasic fit of a single replicate is shown.

FIG. 10C shows the quantification of cleavage rates of CasX variants on GTC PAM, as described in Example 5. Target DNA substrates with identical spacers and the indicated PAM sequence were incubated with a 20-fold excess of the indicated RNP at 37° C. and the amount of cleaved target was determined at the indicated time points. Monophasic fit of a single replicate is shown.

FIG. 10D shows the quantification of cleavage rates of CasX variants on ATC PAM, as described in Example 5. Target DNA substrates with identical spacers and the indicated PAM sequence were incubated with a 20-fold excess of the indicated RNP at 37° C. and the amount of cleaved target was determined at the indicated time points. Monophasic fit of a single replicate is shown.

FIG. 20 is a schematic of the triplex mutagenesis designed to specifically incorporate alternate triplex-forming base pairs into the triplex, as described in Example 13. Solid lines indicate the Watson-Crick pair in the triplex; the third strand nucleotide is indicated as a dotted line representing the non-canonical interaction with the purine of the duplex. In the library, each of the 5 locations indicated was replaced with all possible triplex motifs (G:GC, T:AT, G:GC)=243 sequences. Sequence of

ACUGGCGCUUUUAUCUGAUUACUUUGAGAGCCAUCANNNAUCAAAG. (SEQ ID NO: 1022)

Figure 21:
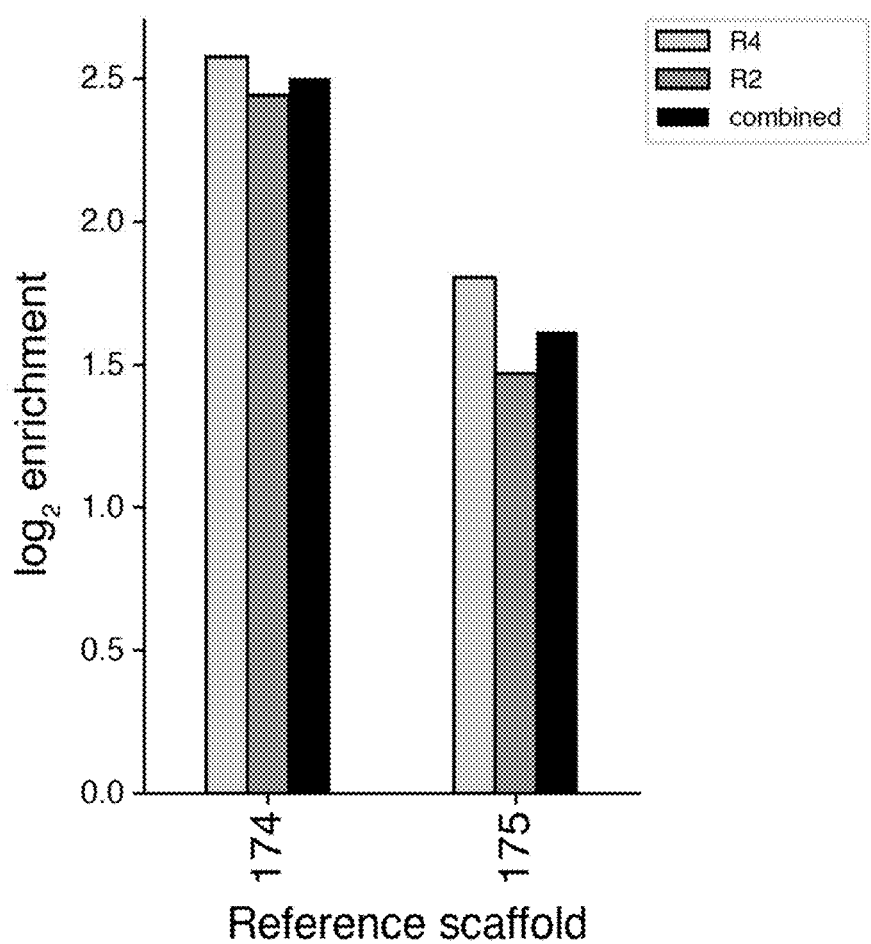

FIG. 21 is a bar chart with results of the enrichment values of reference guide scaffolds 174 and 175 in each screen, as described in Example 13.

Figure 22:
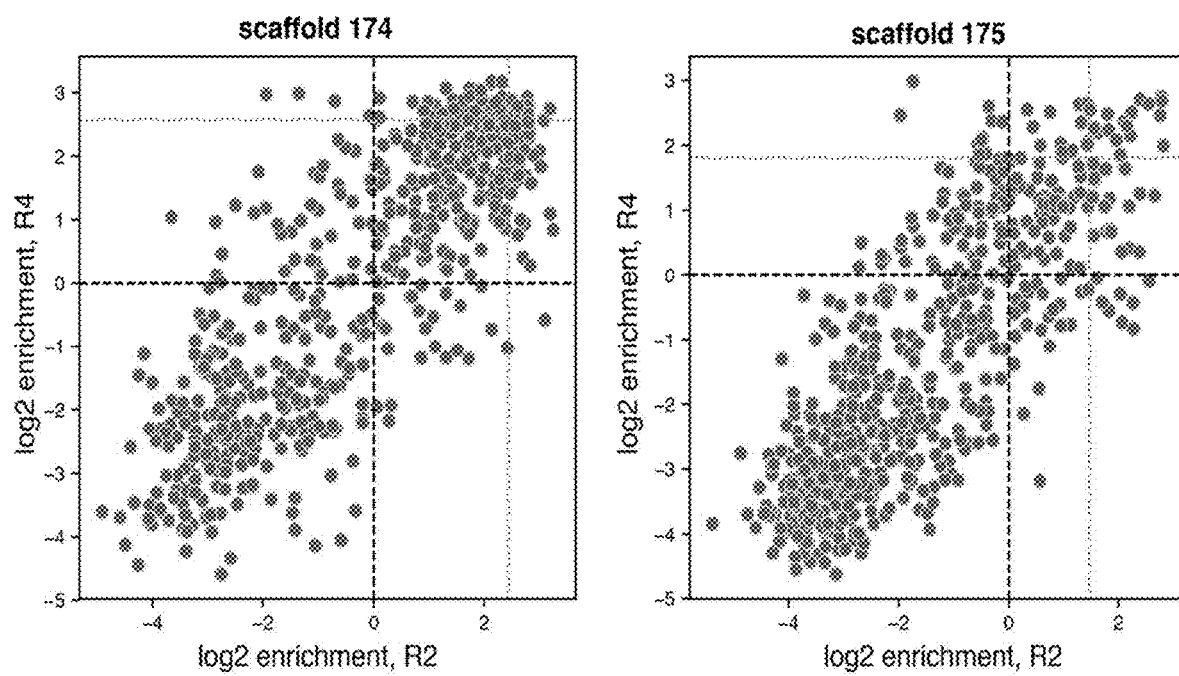

FIG. 22 are scatterplots showing the $\log_2$ enrichment value for each measured single nucleotide substitution, deletion, or insertion, as measured in each of two independent screens of the mutant libraries for guide scaffolds 174 and 175, as described in Example 13.

Figure 23:
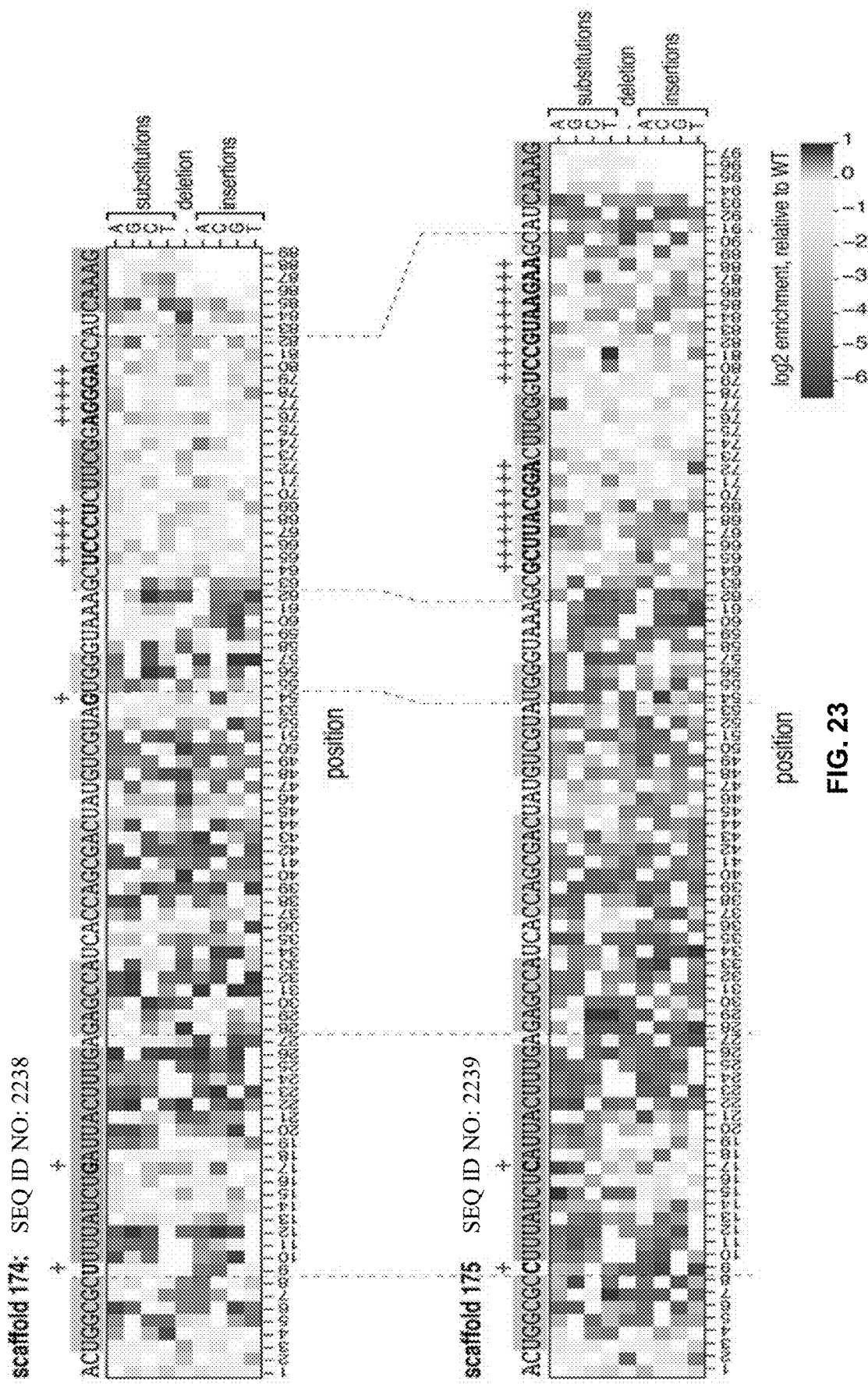

FIG. 23 are heat maps for single mutants in guide scaffolds 174 and 175 showing specific mutable regions in the scaffold across the sequences, as described in Example 13. Yellow shades reflect values with similar enrichment to the reference scaffolds; red shades indicate an increase in enrichment, and thus activity, relative to the reference scaffold; blue shades indicate a loss of activity relative to the wildtype scaffold; white indicates missing data (or a substitution that would result in wildtype sequence.

Figure 24:
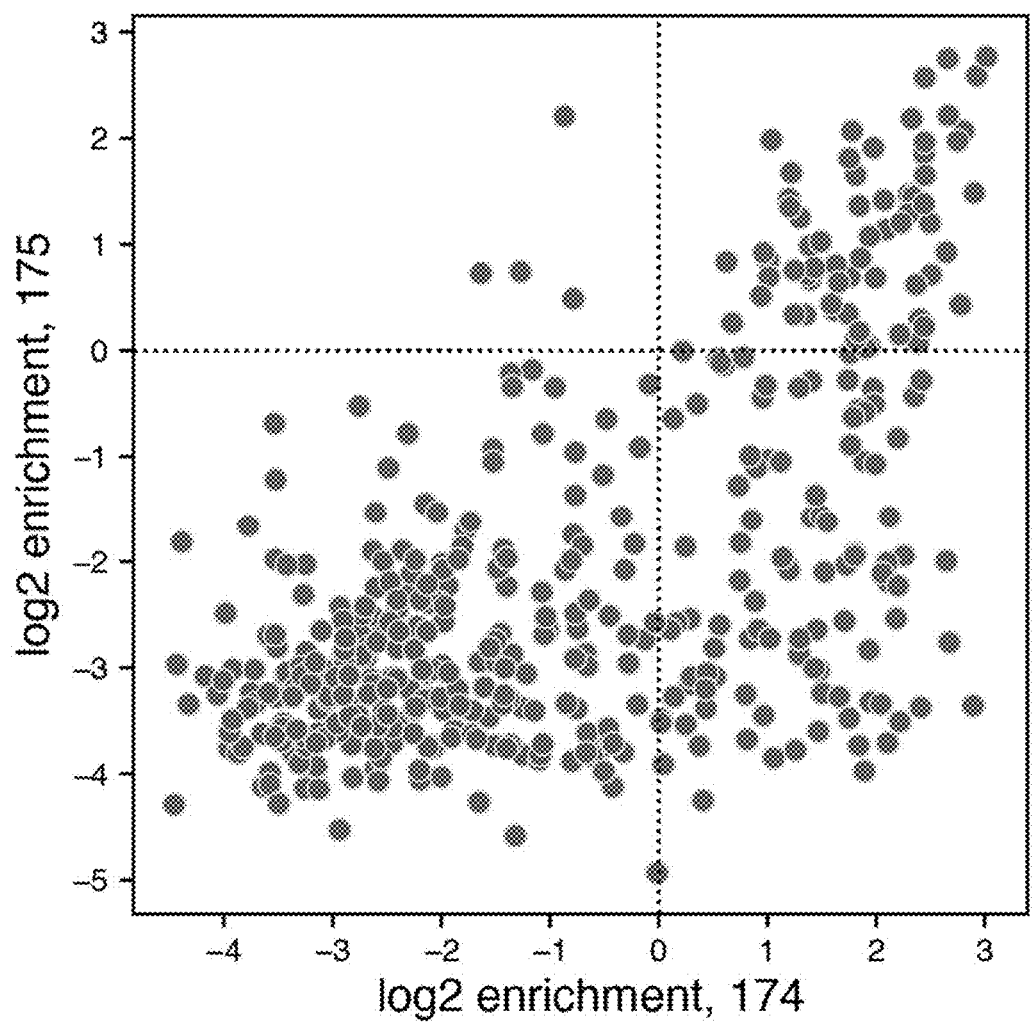

FIG. 24 is a scatterplot that compares the $\log_2$ enrichment of single nucleotide mutations on reference guide scaffolds 174 and 175, as described in Example 13. Only those mutations to positions that were analogous between 174 and 175 are shown. Results suggest that, overall, guide scaffold 174 is more tolerant to changes than 175.

Figure 25:
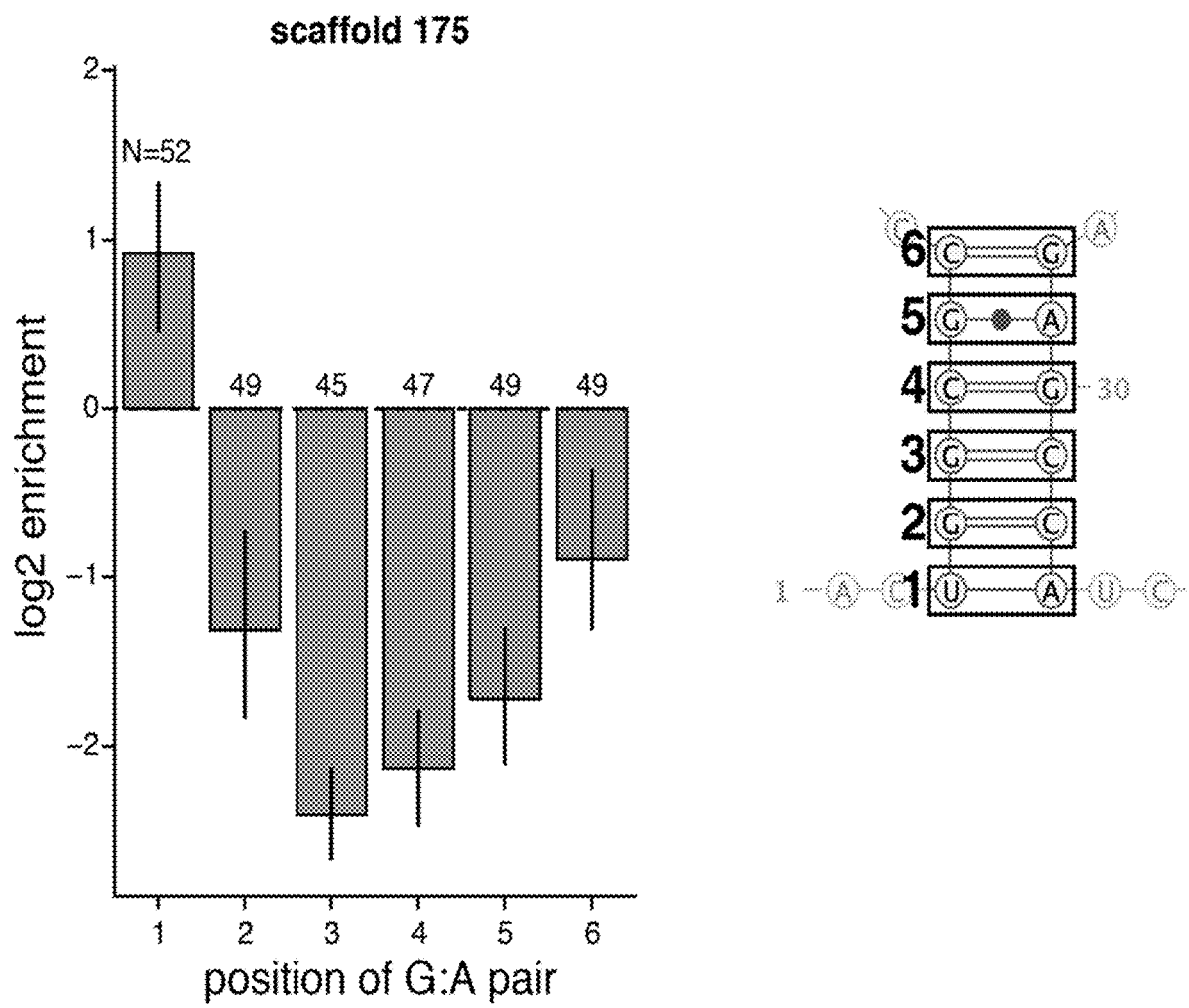

FIG. 25 is a bar chart showing the average (and 95% confidence interval) $\log_2$ enrichment values for a set of scaffolds in which the pseudoknot pairs have been shuffled, such that each new pseudoknot has the same composition of base pairs, but in a different order within the stem, as described in Example 13. Each bar represents a set of scaffolds with the G:A (or A:G) pair location indicated (see diagram at right). 291 pseudoknot stems were tested; numbers above bars indicate the number of stems with the G:A (or A:G) pair at each position.

Figure 26:
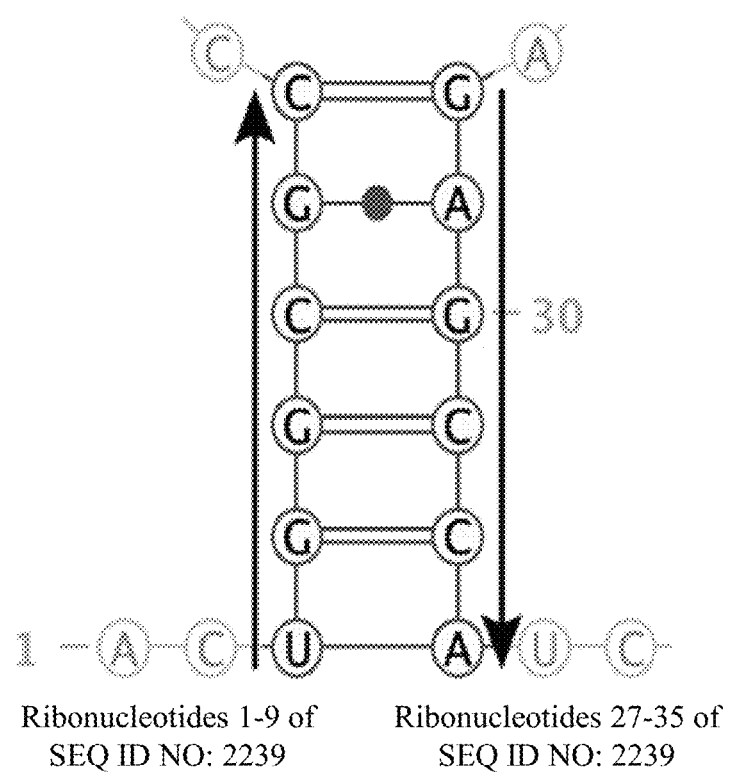

FIG. 26 is a schematic of the pseudoknot sequence of FIGS. 55 and 56, given 5' to 3', with the two strand sequences separated by an underscore.

Figure 27:
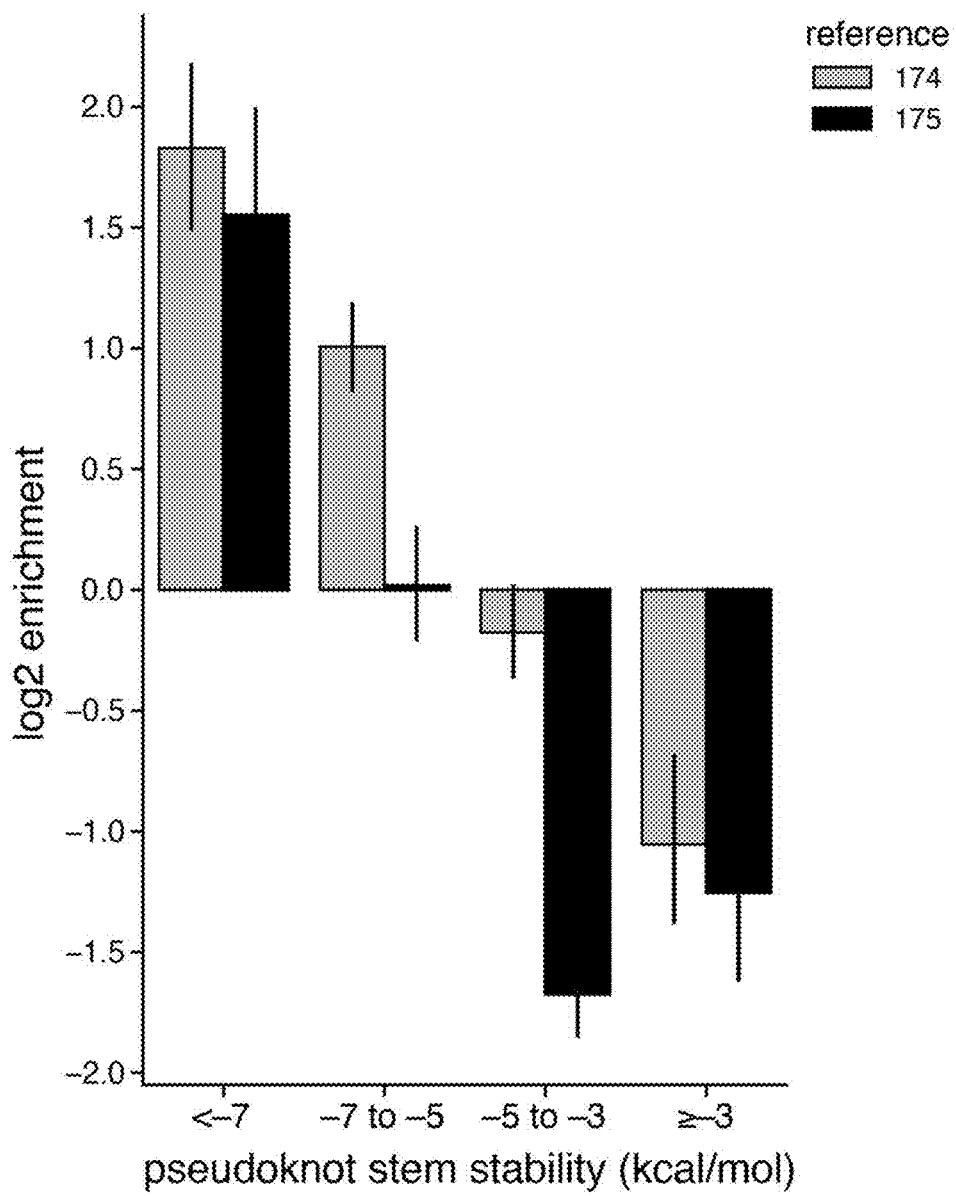

FIG. 27 is a bar chart showing the average (and 95% confidence interval) $\log_2$ enrichment values for scaffolds, divided by the predicted secondary structure stability of the pseudoknot stem region, as described in Example 13. Scaffolds with very stable stems (e.g., $\Delta G < -7$ kcal/mol) had high enrichment values on average, whereas scaffolds with destabilized stems ($\Delta G \geq -5$ kcal/mol) had low enrichment values on average.

Figure 28:
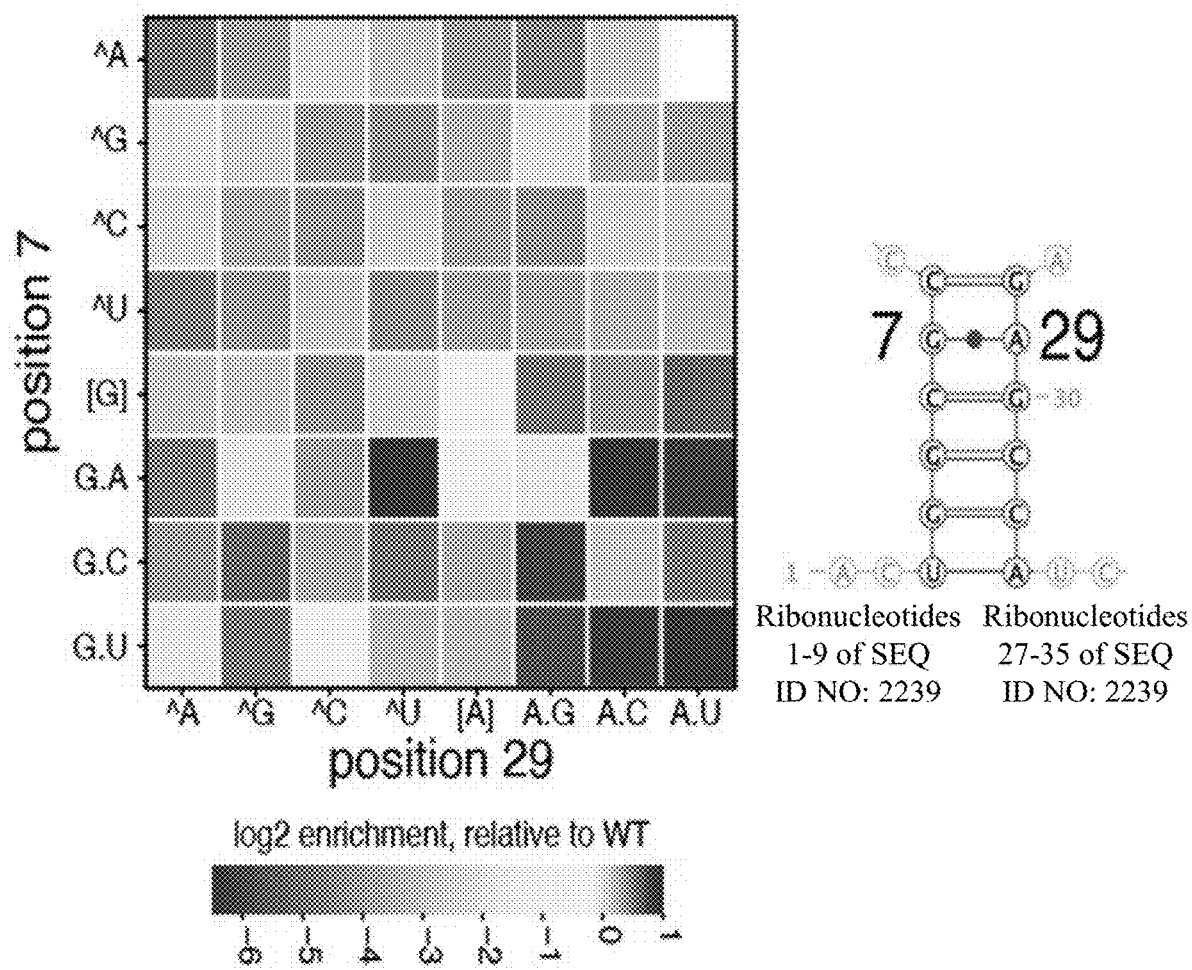

FIG. 28 is a heat map of all double mutants of positions 7 and 29 in scaffold 175, as described in Example 13. The pseudoknot sequence is given 5' to 3', on the right.

Figure 29B:
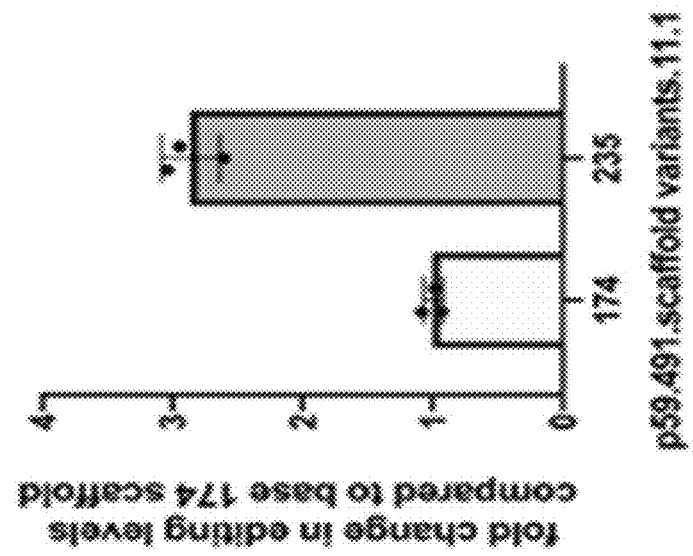
Figure 29A:
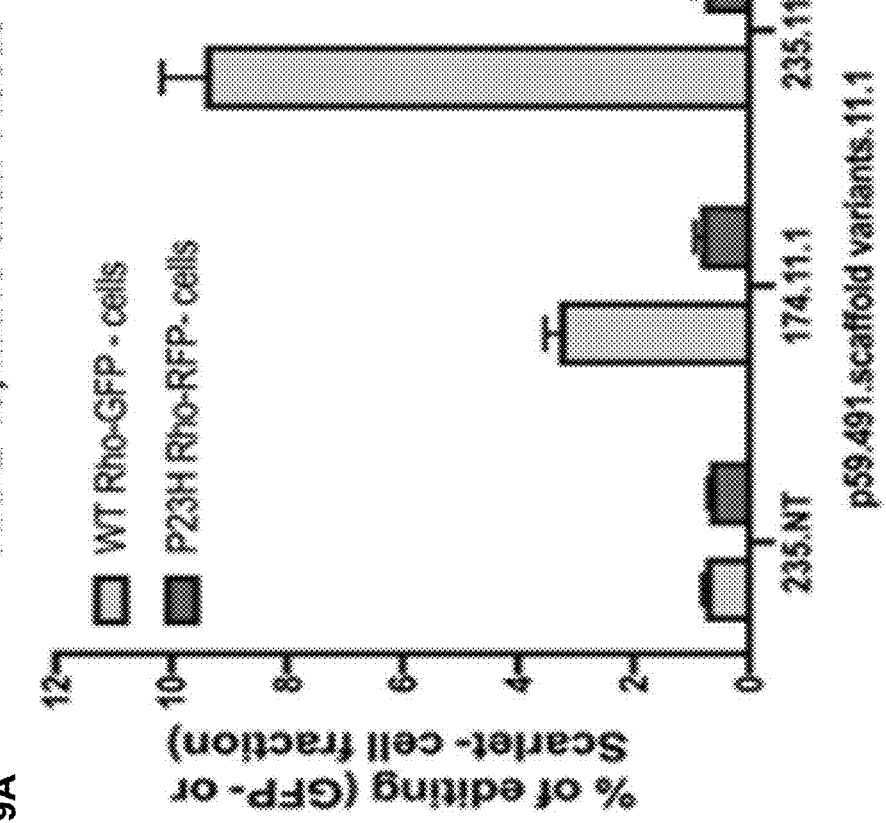

FIG. 29A show editing results in ARPE-19 nucleofected cells using engineered guide 235 compared to 174 with the 11.1 spacer targeting the P23 site of Rho locus (with CasX 491), demonstrating improved activity by the 235 variant, with increased on-target activity at WT exogenous RHO without off-target cleavage at the mutant RHO reporter gene (by the non-targeting spacer), as described in Example 21.

FIG. 29B is a bar graph displaying fold-change in editing levels of p59.491.235.11.1 normalized to benchmark p59.491.174.11.1 levels (set to value 1.0) in ARPE-1 cells nucleofected with 1000 ng of each plasmid, as described in Example 21.

Figure 30:
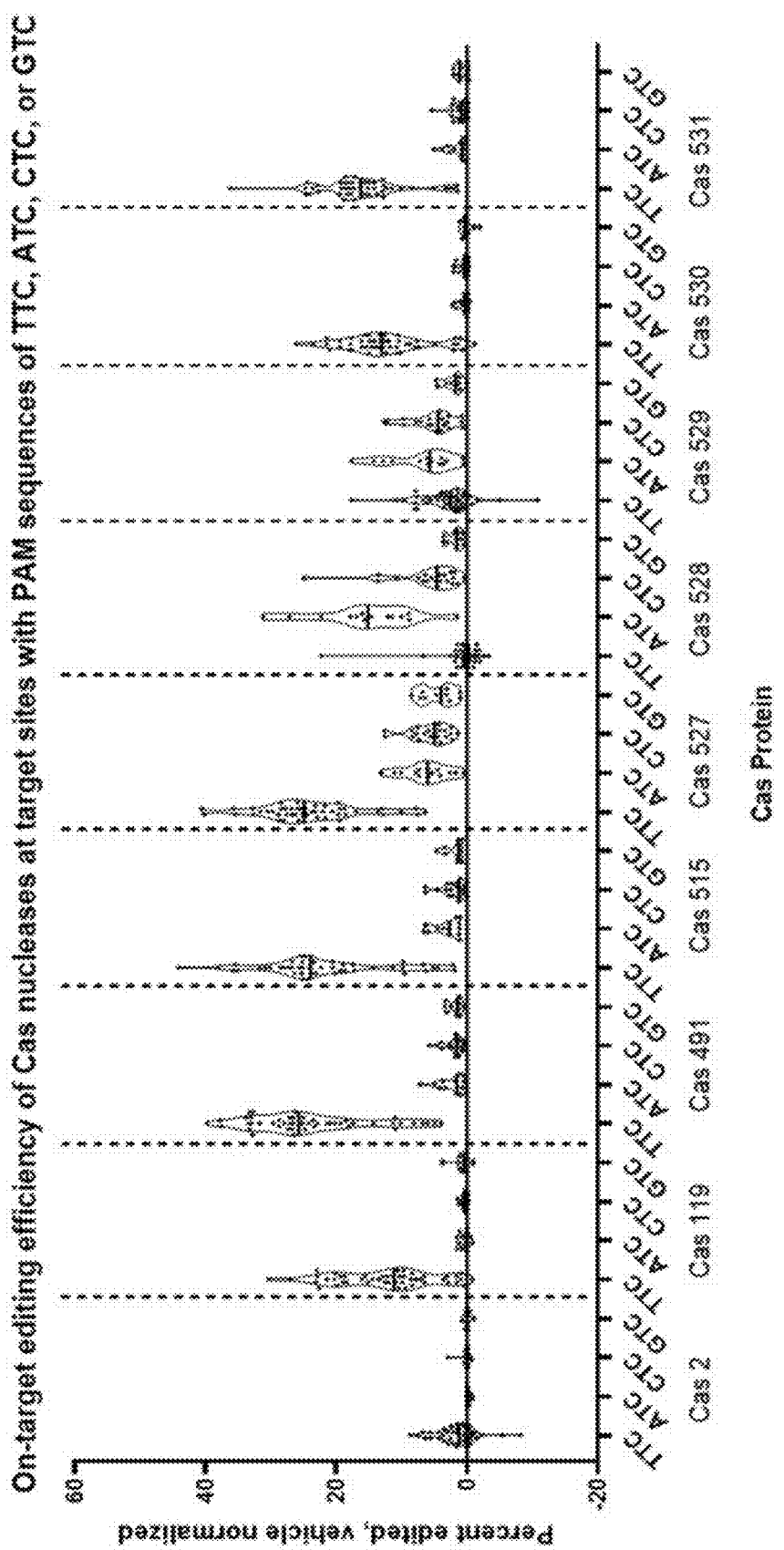

FIG. 30 shows the results of an editing assay comparing Cas nucleases 2, 119, 491, 515, 527, 528, 529, 530, and 531 in a custom HEK293 cell line, PASS_V1.01, as described in Example 17. Cells were lipofected with 2 µg of p67 plasmid encoding the indicated Cas protein. After five days, cell genomic DNA was extracted. PCR amplification and Next-Generation Sequencing was performed to isolate and quantify the fraction of edited cells at custom designed on-target editing sites. For each sample, editing was evaluated at target sites (individual points) consisting of the following PAM sequences: 48 TTC, 14 ATC, 22 CTC, 11 GTC individual sites, and percent editing was normalized to a vehicle control. Cells lipofected with any nuclease displayed higher mean editing at TTC PAM target sites (horizontal bar) than that of the wild-type nuclease Cas 2, except Cas 528. The relative preference of any given nuclease for the four different PAM sequences is also represented by the violin plots. In particular, Cas nucleases 527, 528, and 529 exhibit substantially different PAM preferences than that of the wild-type nuclease Cas 2.

Figure 31:
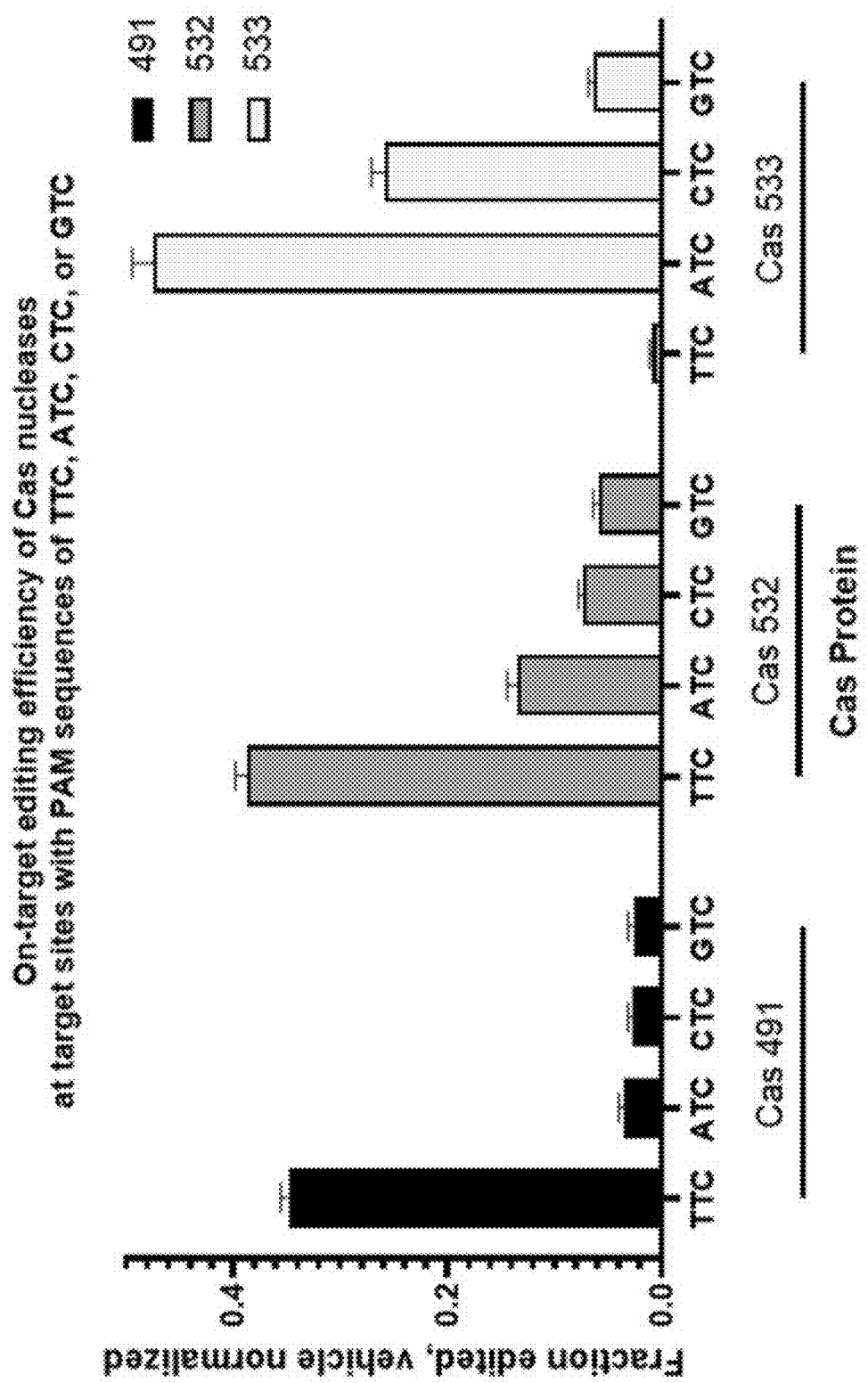
Figure 32:
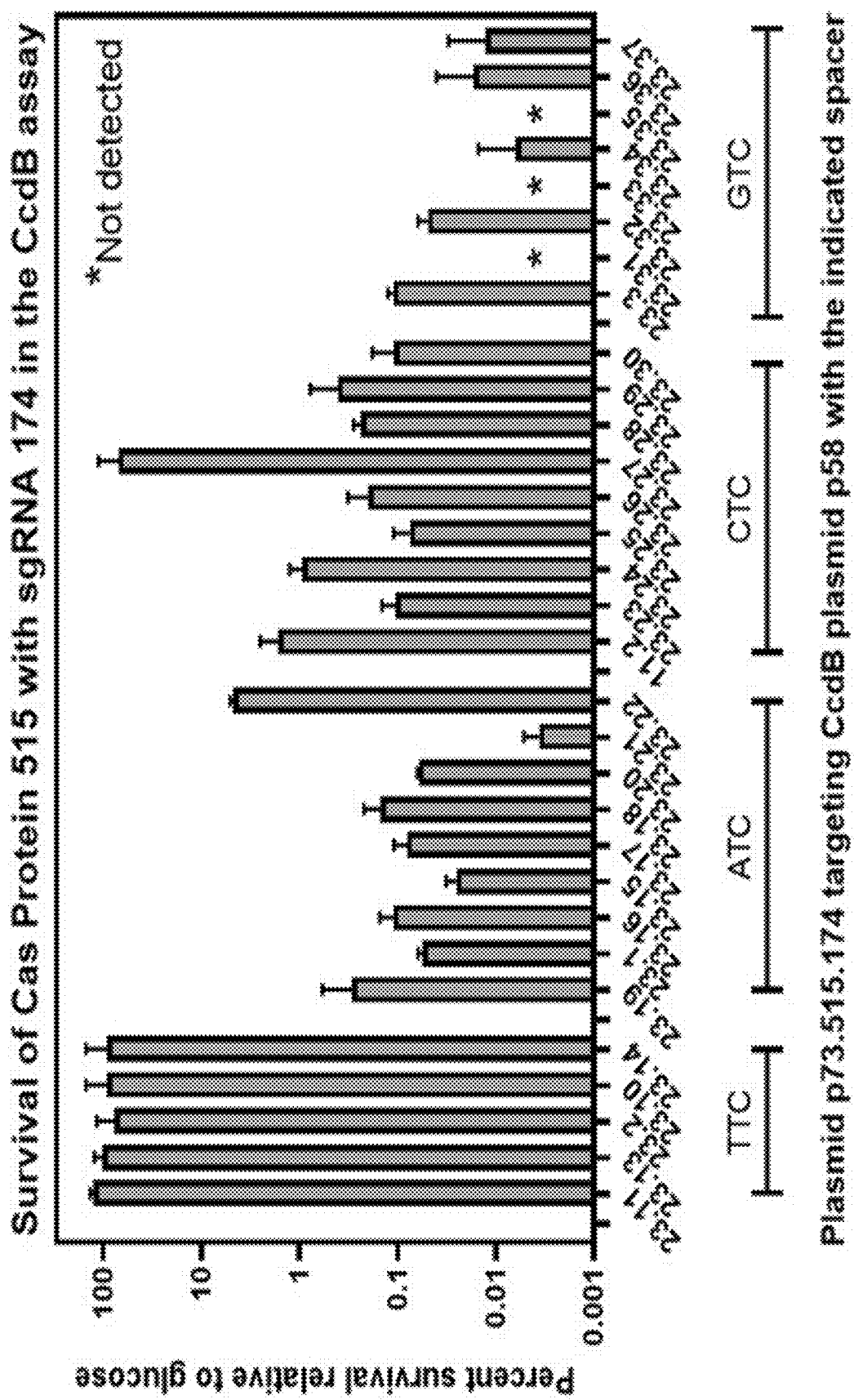
Figure 33A:
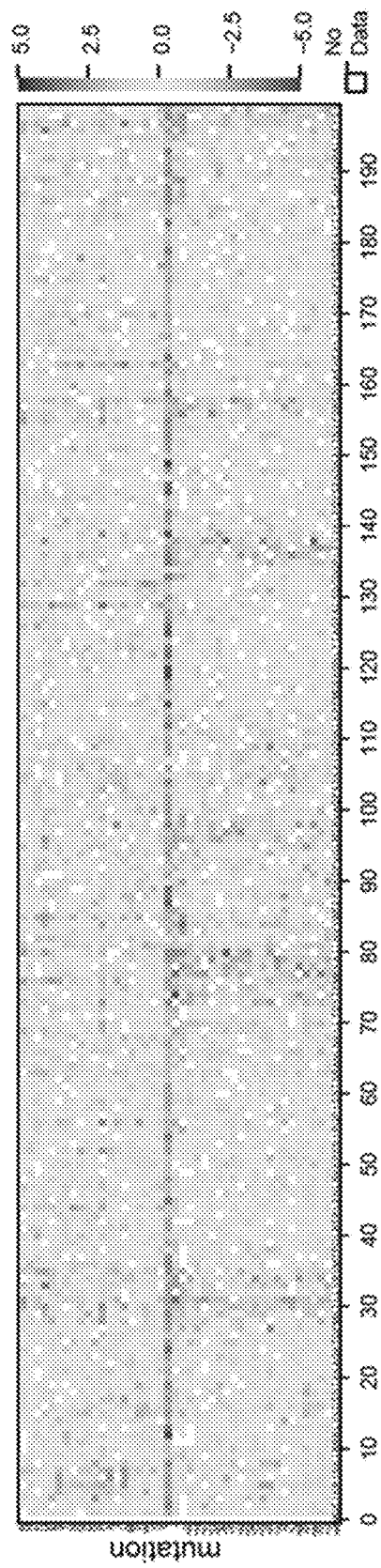
Figure 33B:
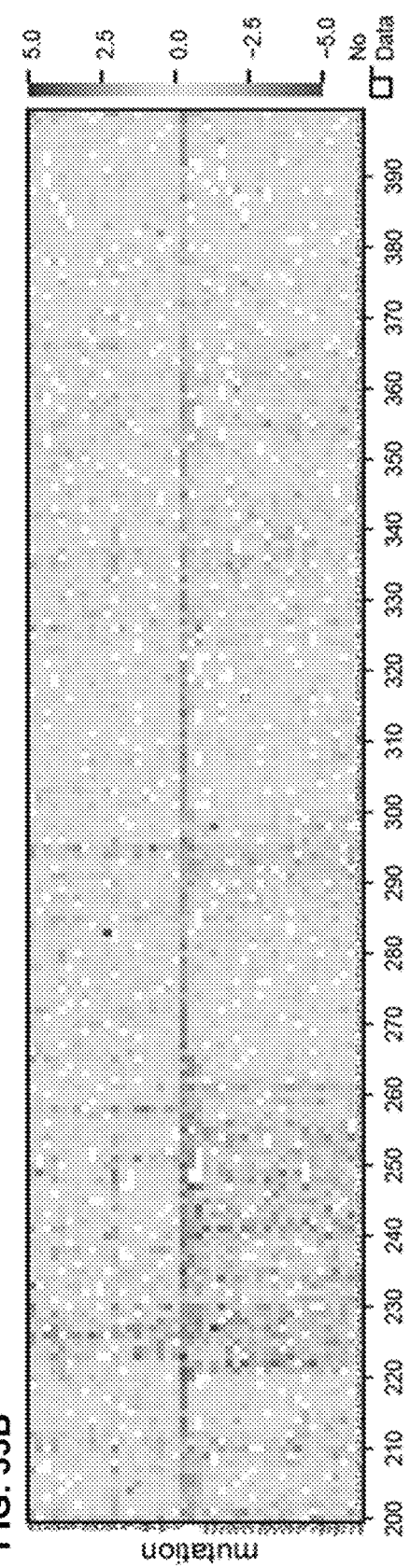
Figure 33C:
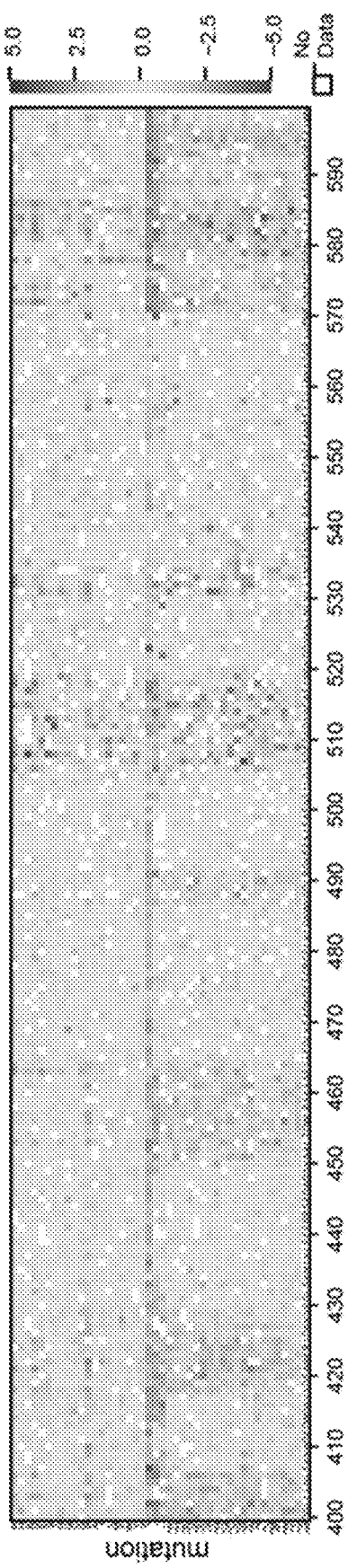
Figure 33D:
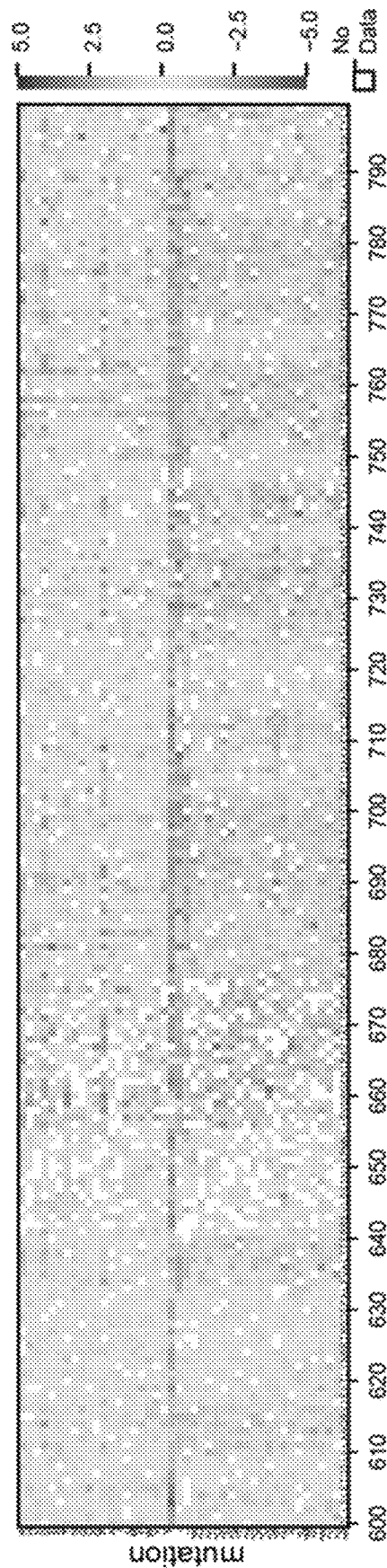
Figure 33E:
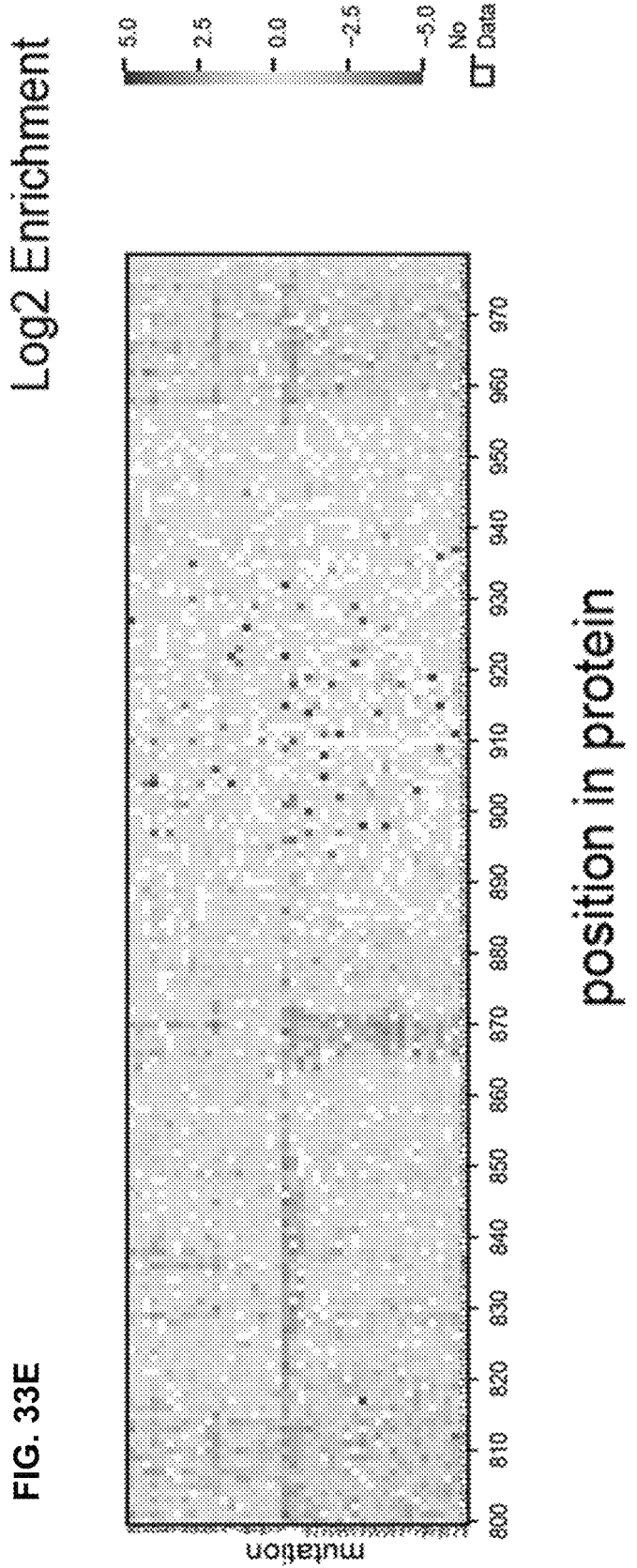
Figure 34A:
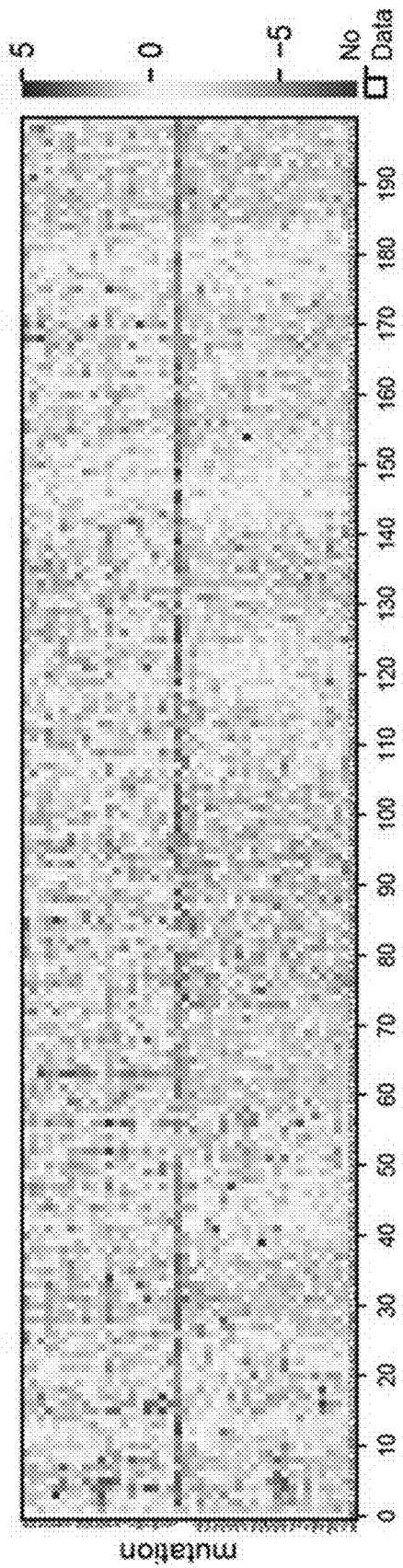
Figure 34B:
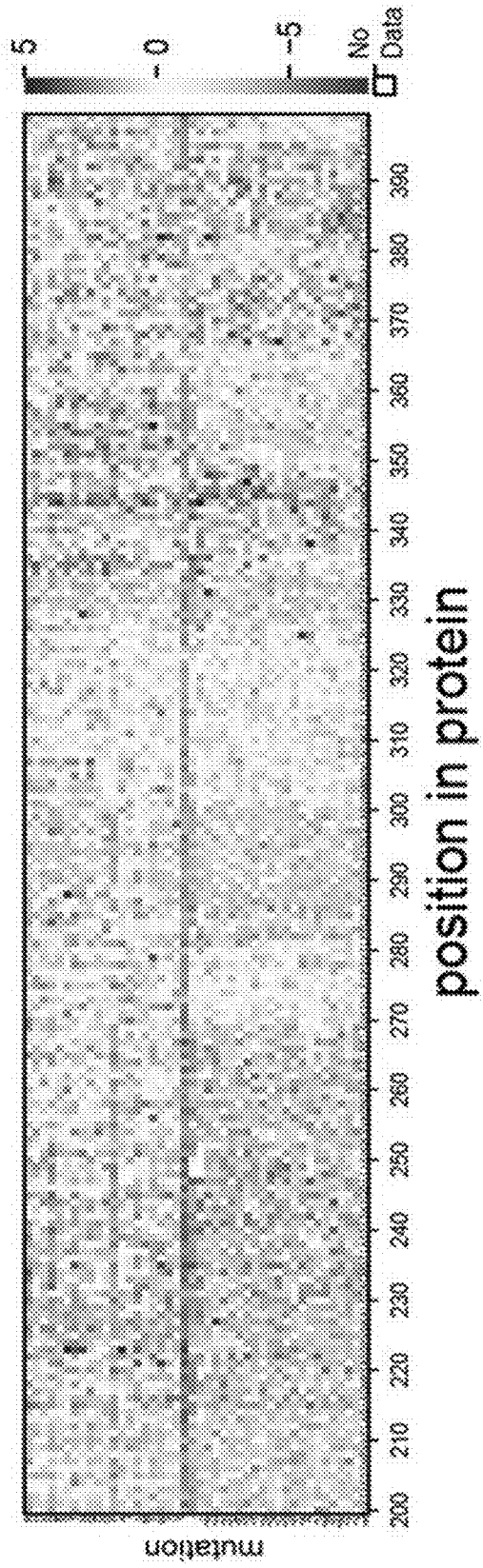
Figure 34C:
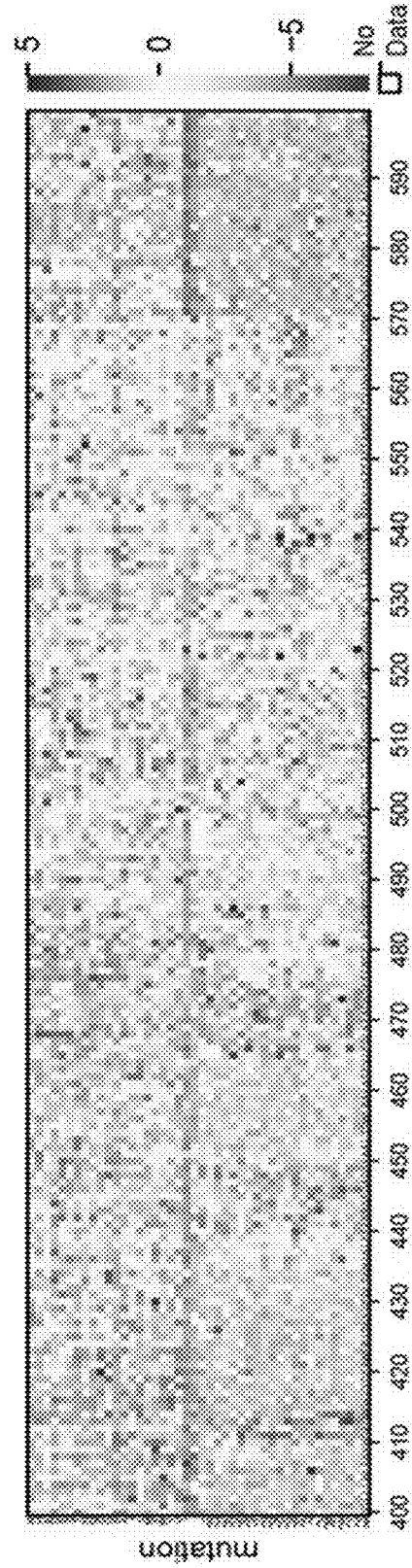
Figure 34D:
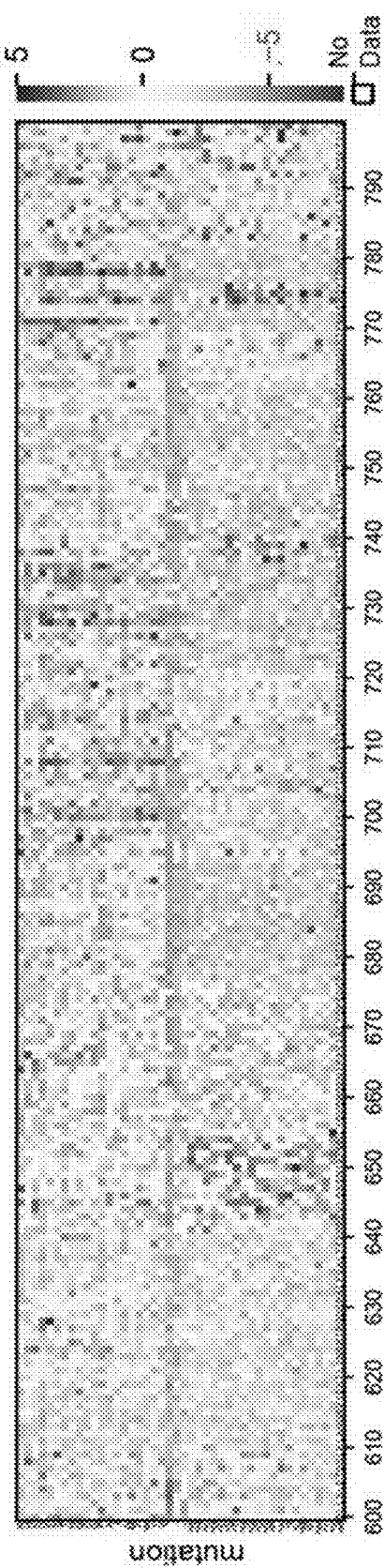
Figure 34E:
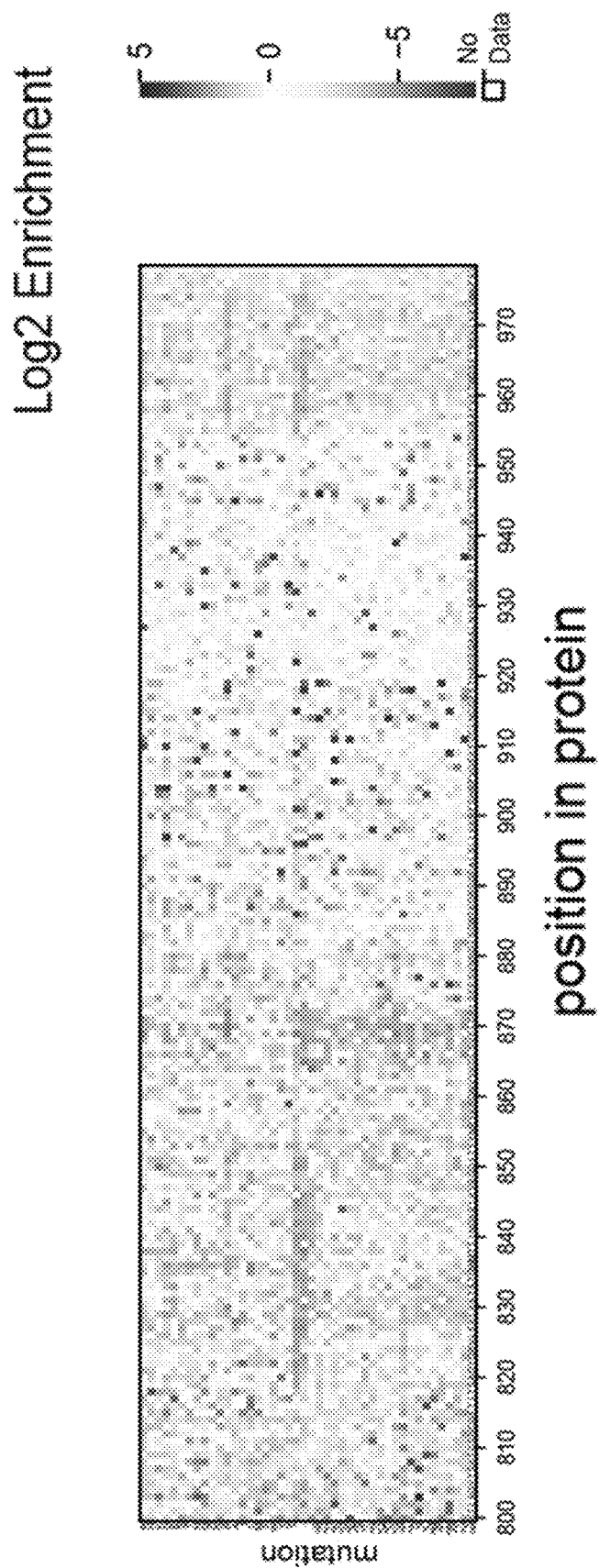
Figure 35C:
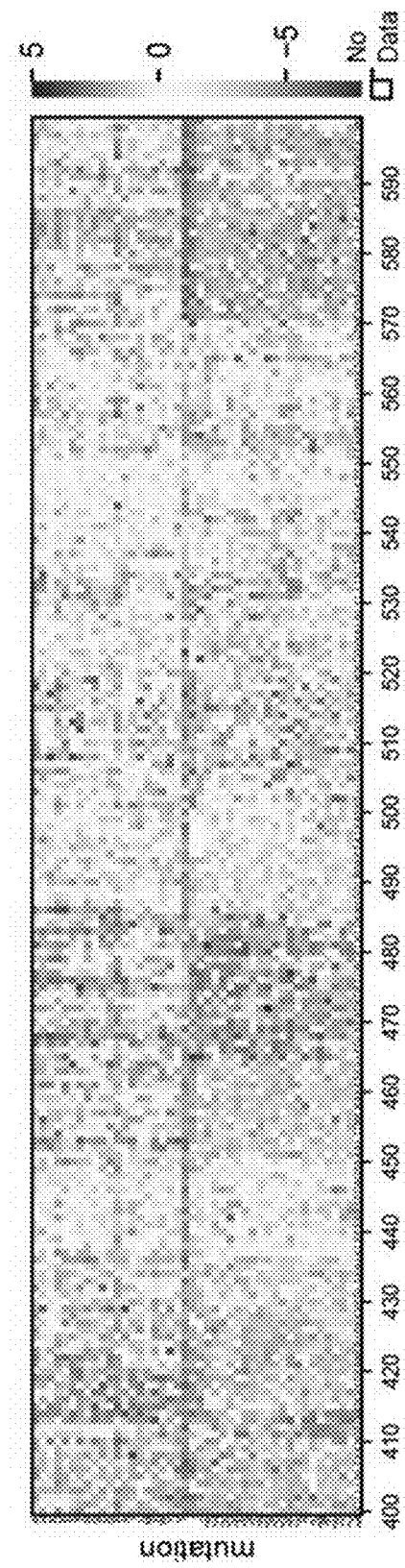
Figure 35D:
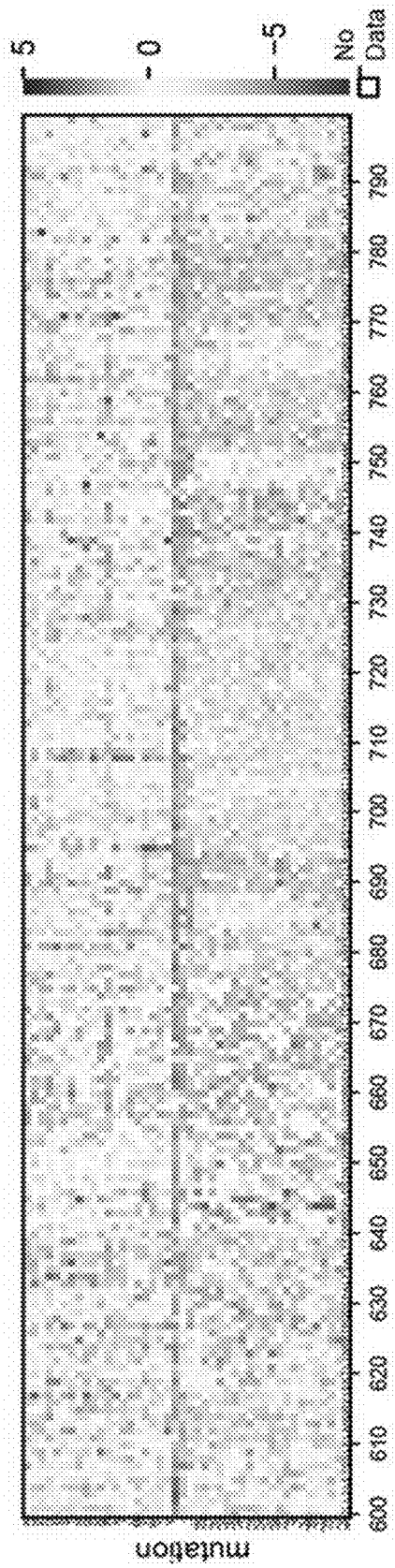
Figure 35E:
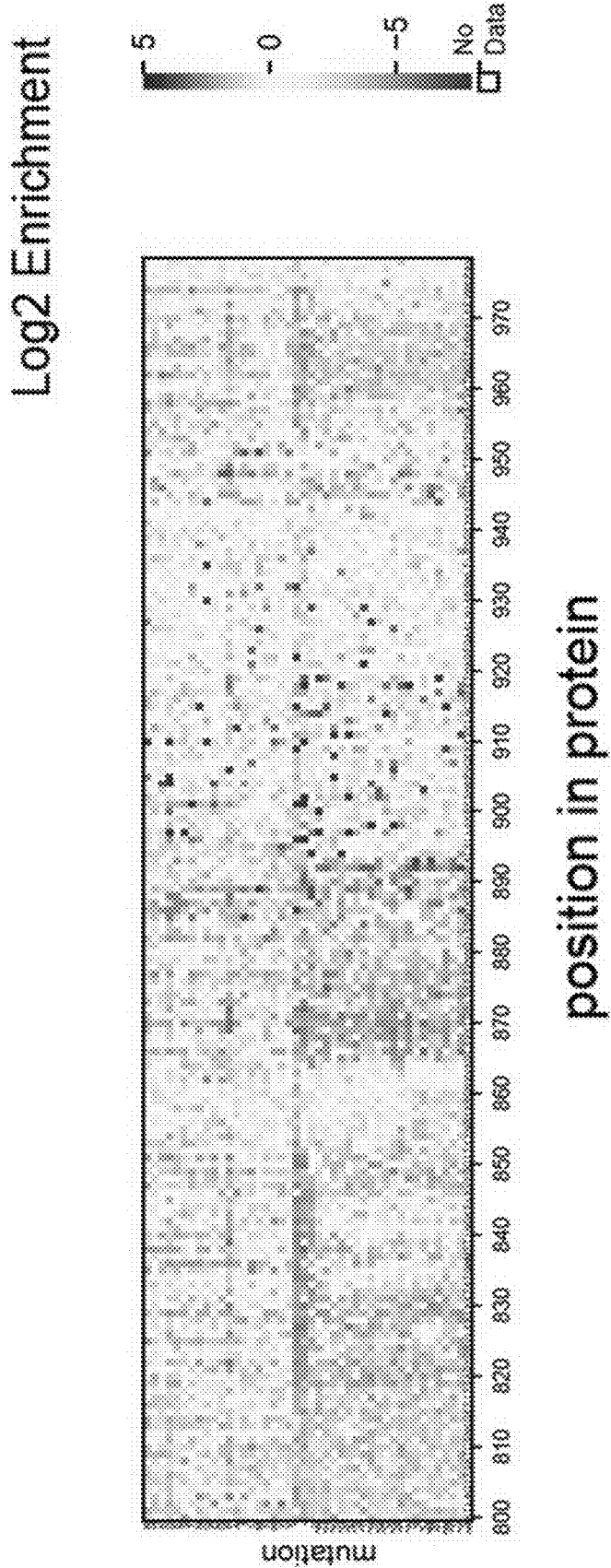
Figure 36A:
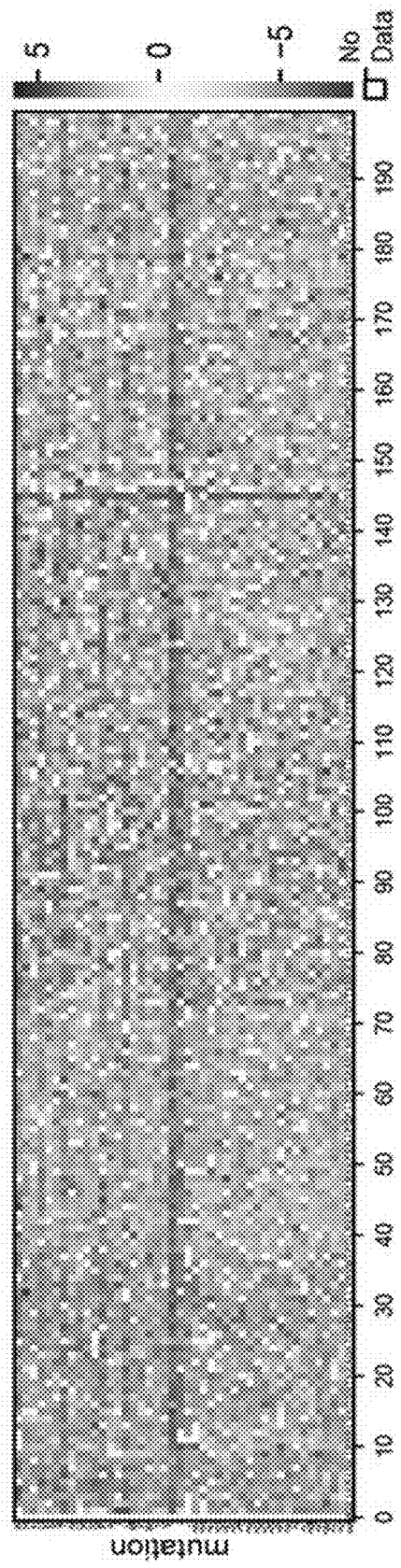
Figure 36B:
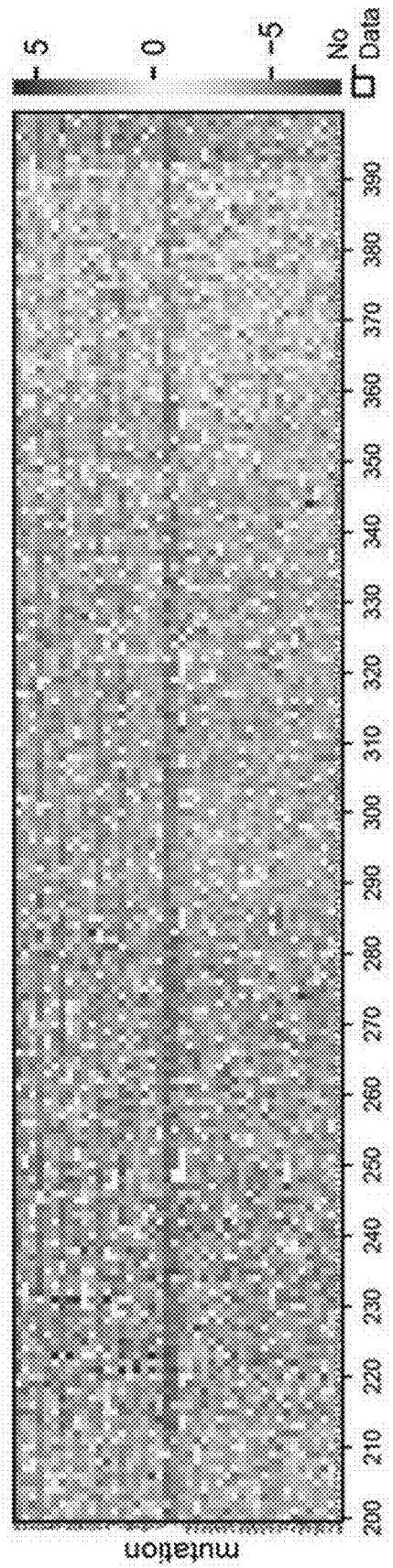
Figure 36C:
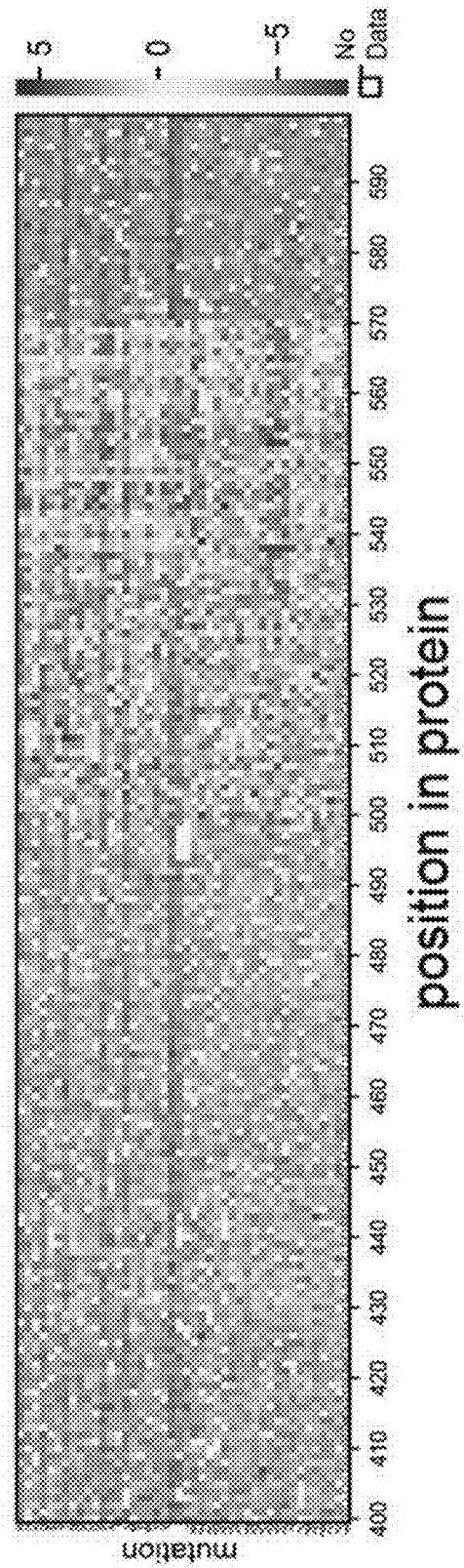
Figure 36D:
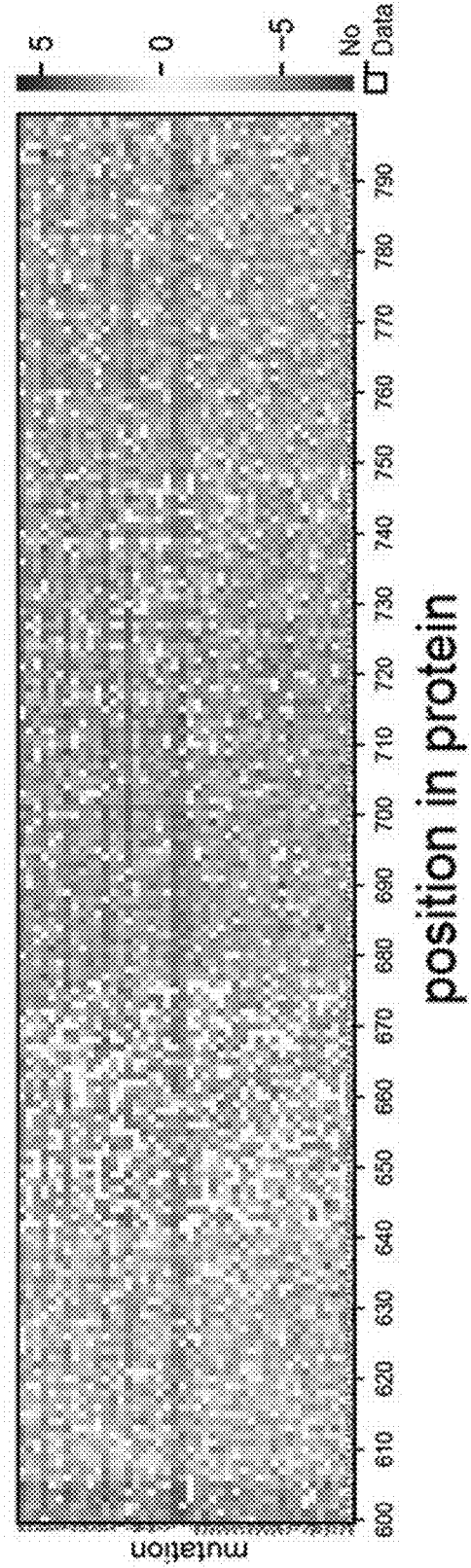
Figure 36E:
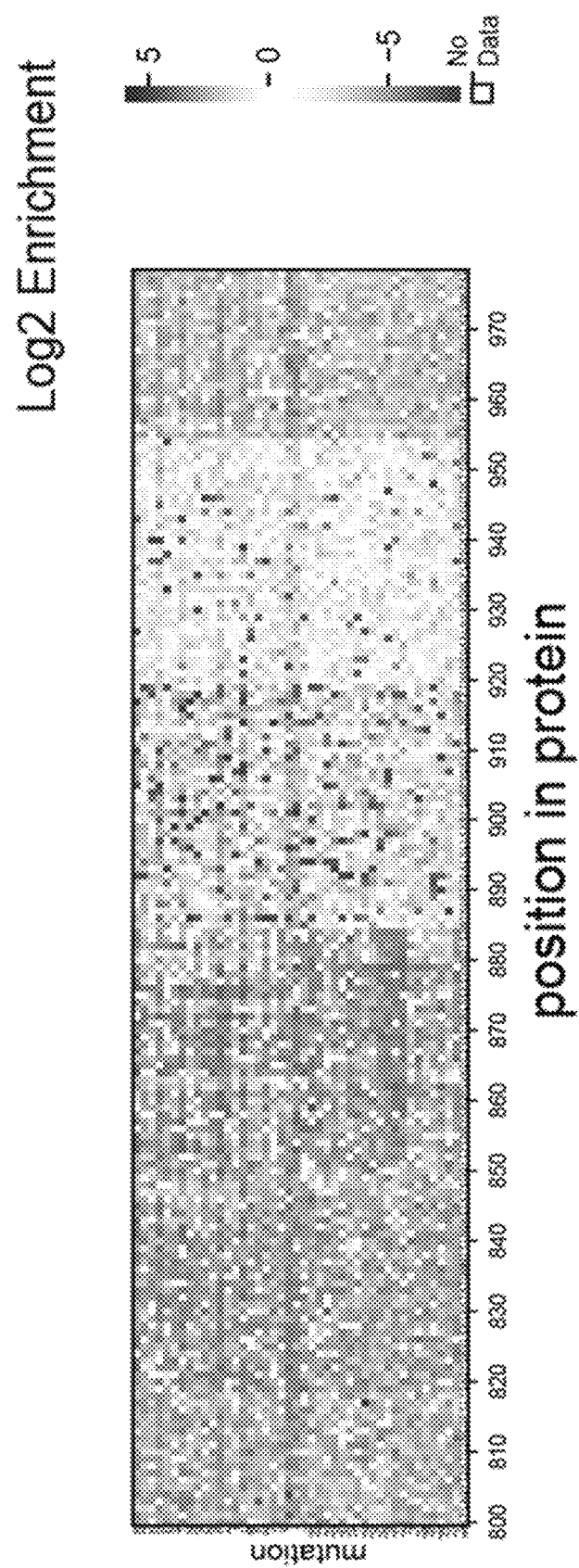

FIG. 31 shows the results of an editing assay comparing improved Cas nuclease 491 to improved nucleases 532 and 533 in a custom HEK293 cell line, PASS_V1.01, as described in Example 18. Cells were lipofected, in duplicate, with 2 µg of p67 plasmid encoding the indicated Cas protein and a puromycin resistance gene, and grown under puromycin selection. After three days, cell genomic DNA was extracted. PCR amplification and Next-Generation Sequencing was performed to isolate and quantify the fraction of edited cells at custom designed on-target editing sites. For each sample, editing was evaluated at target sites consisting of the following PAM sequences: 48 TTC, 14 ATC, 22 CTC, 11 GTC individual sites, and fraction editing was normalized to a vehicle control. Cells lipofected with Cas 532 or 533 displayed higher mean editing than Cas 491 at each of the PAM sequences, with the exception of Cas 533 at TTC PAM target sites. Error bars represent standard error of the mean for n=2 biological samples FIG. 32 is a graph of a survival assay to determine the selective stringency of the CcdB selection to different spacers when targeted by CasX protein 515 and Scaffold 174, as described in Example 14.

FIGS. 33A-E are heat maps of variants of CasX 515 demonstrating neutral or improved biochemical cleavage for each mutant at a TTC PAM target site as an average of three spacers, as described in Example 14. The figures show the results across the full length of the CasX 515 sequence.

FIGS. 34A-E are heat maps of variants of CasX 515 demonstrating neutral or improved biochemical cleavage for each mutant at a CTC PAM target site as an average of three biological replicates at a single spacer, as described in Example 14. The figures show the results across the full length of the CasX 515 sequence.

FIGS. 35A-E are heat maps of variants of CasX 515 demonstrating neutral or improved biochemical cleavage for each mutant at a CTC PAM target site as an average of three biological replicates at a single spacer, as described in Example 14. The figures show the results across the full length of the CasX 515 sequence.

FIGS. 36A-E are heat maps of variants of CasX 515 demonstrating neutral or improved biochemical cleavage for each mutant at an ATC PAM target site as an average of three biological replicates at a single spacer, as described in Example 14. The figures show the results across the full length of the CasX 515 sequence.

Figure 37A:
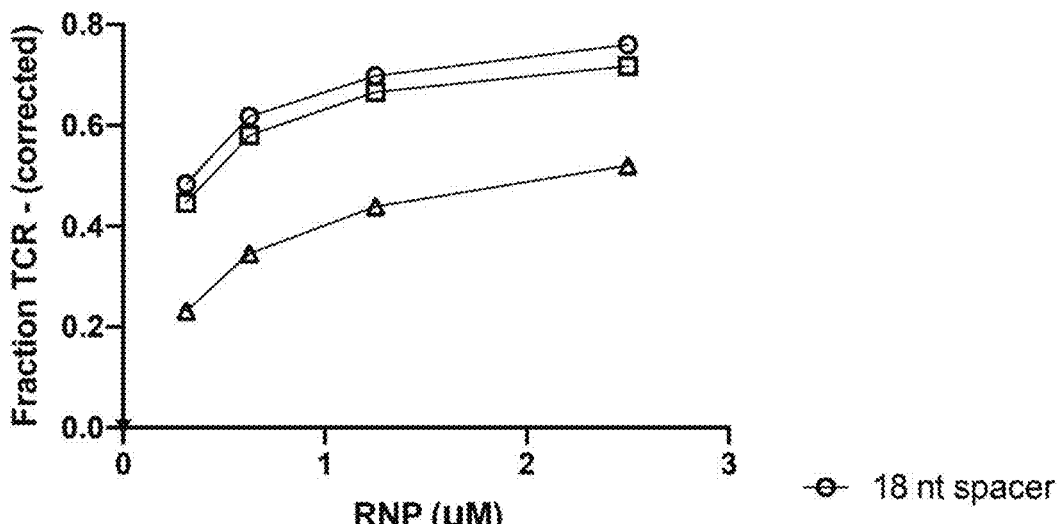

FIG. 37A is a graph showing the effects of spacer length on ability to edit target nucleic acid with RNPs in Jurkat cells, as described in Example 15, for spacer 15.3.

Figure 37B:
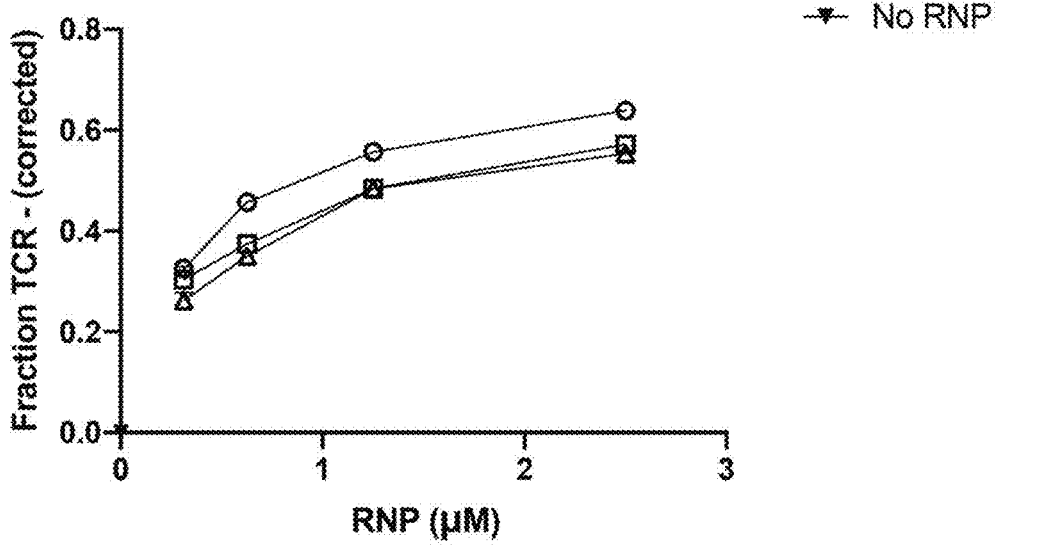

FIG. 37B is a graph showing the effects of spacer length on ability to edit target nucleic acid with RNPs in Jurkat cells, as described in Example 15, for spacer 15.5.

Figure 38:
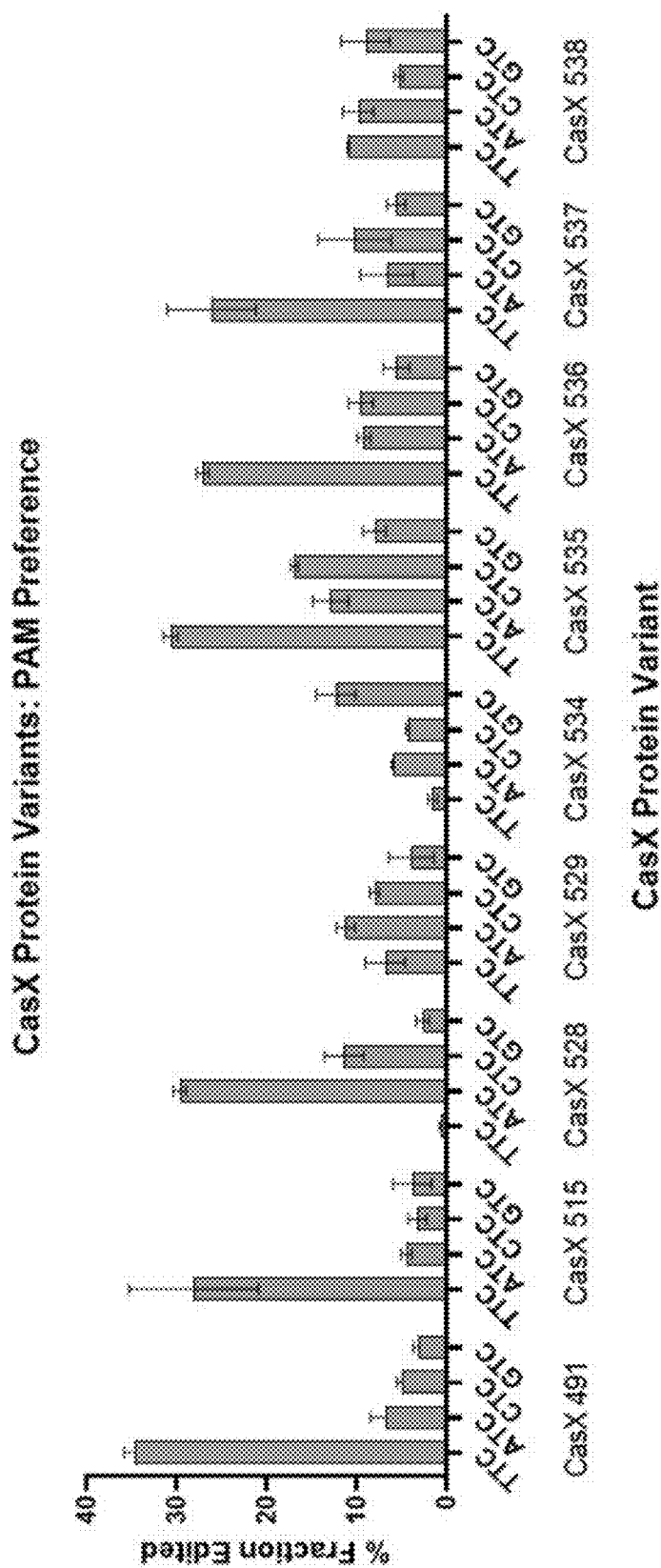

FIG. 38 is a bar plot of select CasX variant proteins and their editing efficiency at four different PAM sequences (TTC, ATC, CTC and GTC) for duplicate samples, as described in Example 16. Data are presented as percent editing +/−SD.

Figure 39:
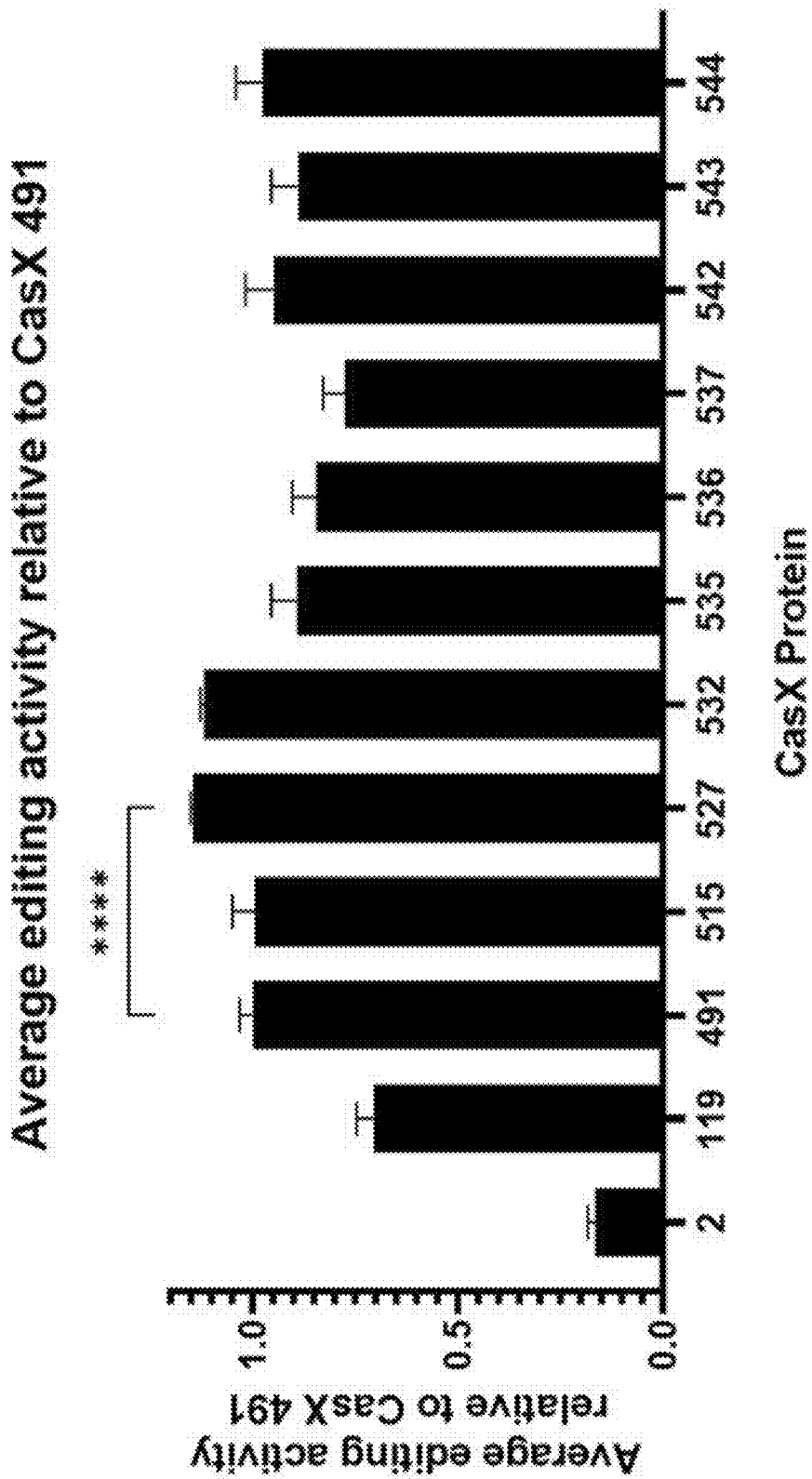

FIG. 39 is a bar plot showing the average editing efficiency relative to CasX 491 of select CasX nucleases at 48 different TTC PAM target sites, as described in Example 19. The propagated standard error of the mean of two experiments plotted as error bars. Asterisks indicate significant difference between CasX 527 and CasX 491 (p=0.0000635 by Welch's two-tailed t-test).

Figure 40:
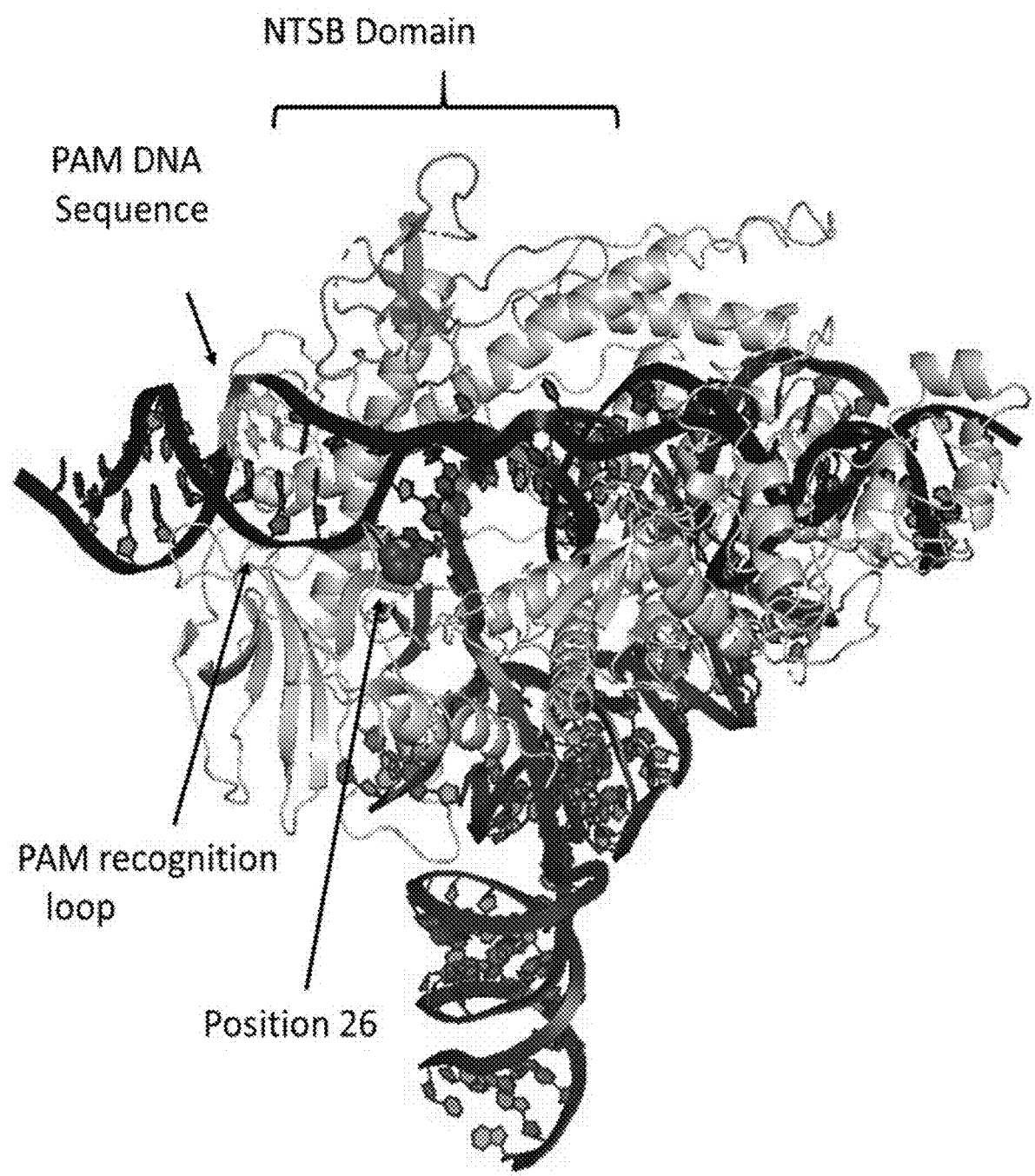

FIG. 40 is a diagram based on the published CryoEM structure of the homologous reference CasX 1 (SEQ ID NO: 1; Protein Data Bank Identification Number: 6NY2) showing the physical locations of the target DNA PAM sequence, the PAM interacting loop, the NTSB domain, and amino acid position 26, as described in Example 19.

Figure 41:
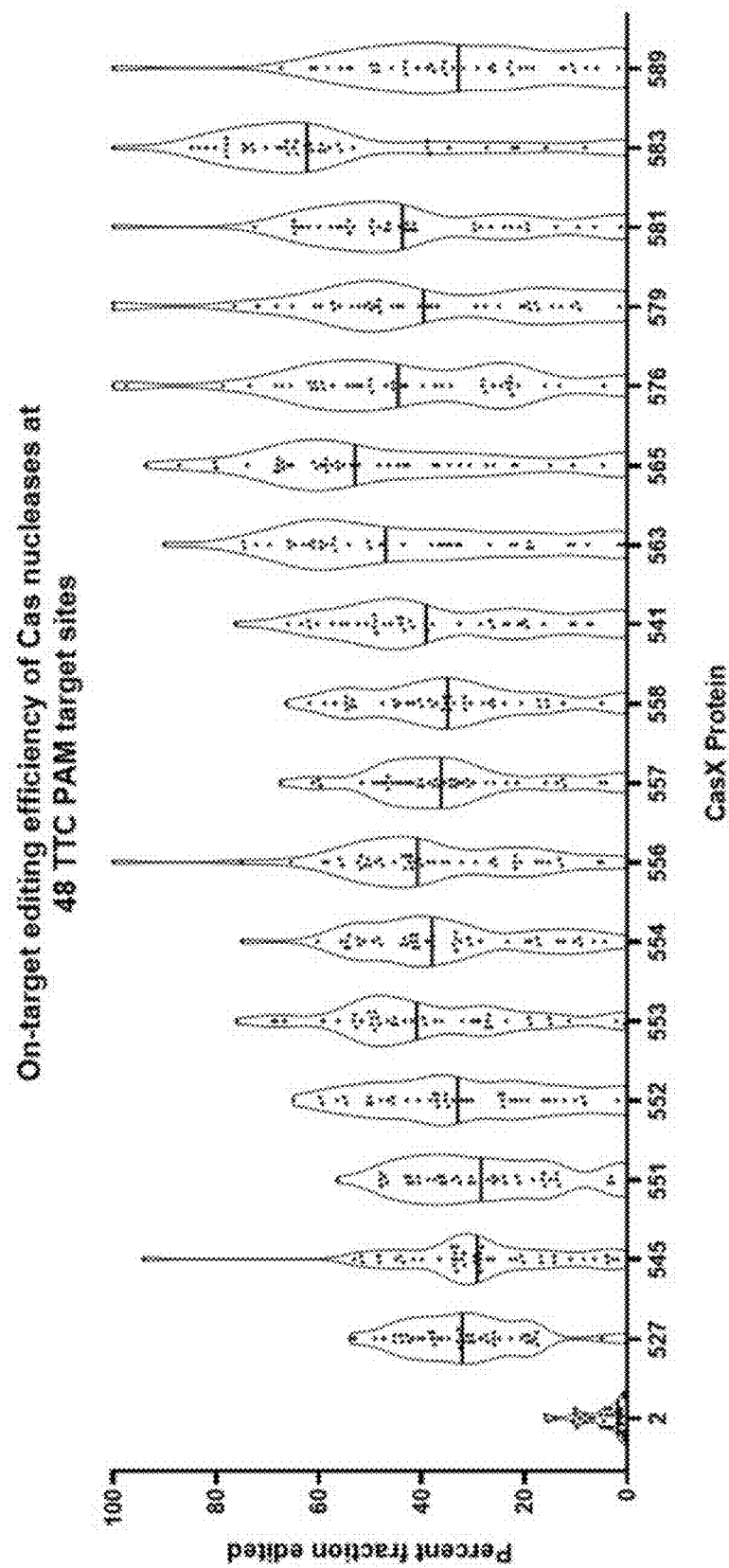

FIG. 41 is a violin plot of select CasX variant proteins and their editing efficiency at 48 TTC PAM target sites as described in Example 19.

Figure 42:
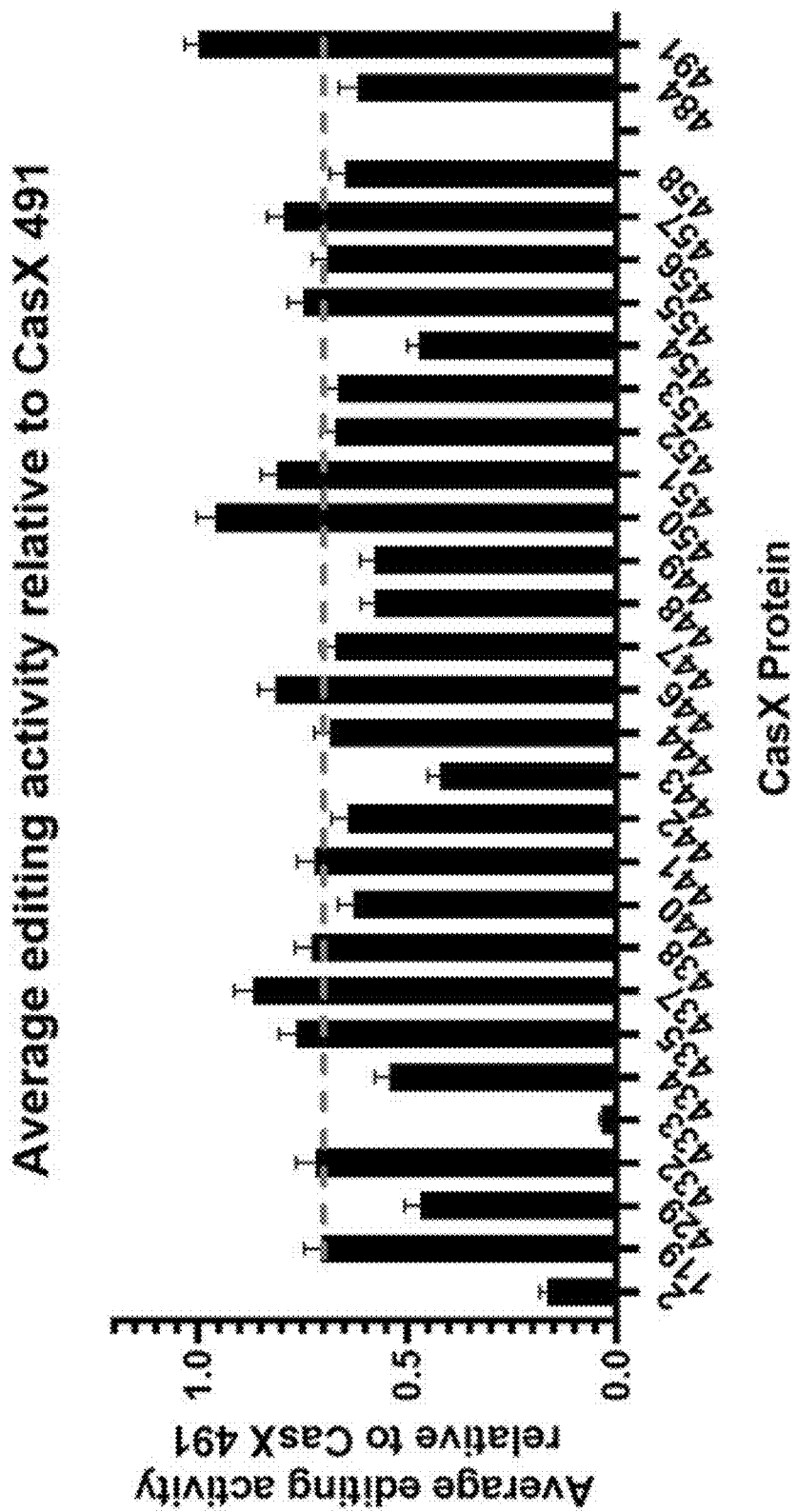

FIG. 42 is a bar plot of select CasX variant proteins and their editing efficiency relative to CasX 491 at 48 TTC PAM target sites, as described in Example 19. Data are presented as average relative editing efficiency where 1.0 is equal CasX 491 editing. The grey dashed line illustrates the editing efficiency of CasX 119. Error is +/− the propagated SEM for duplicate samples.

Figure 43:
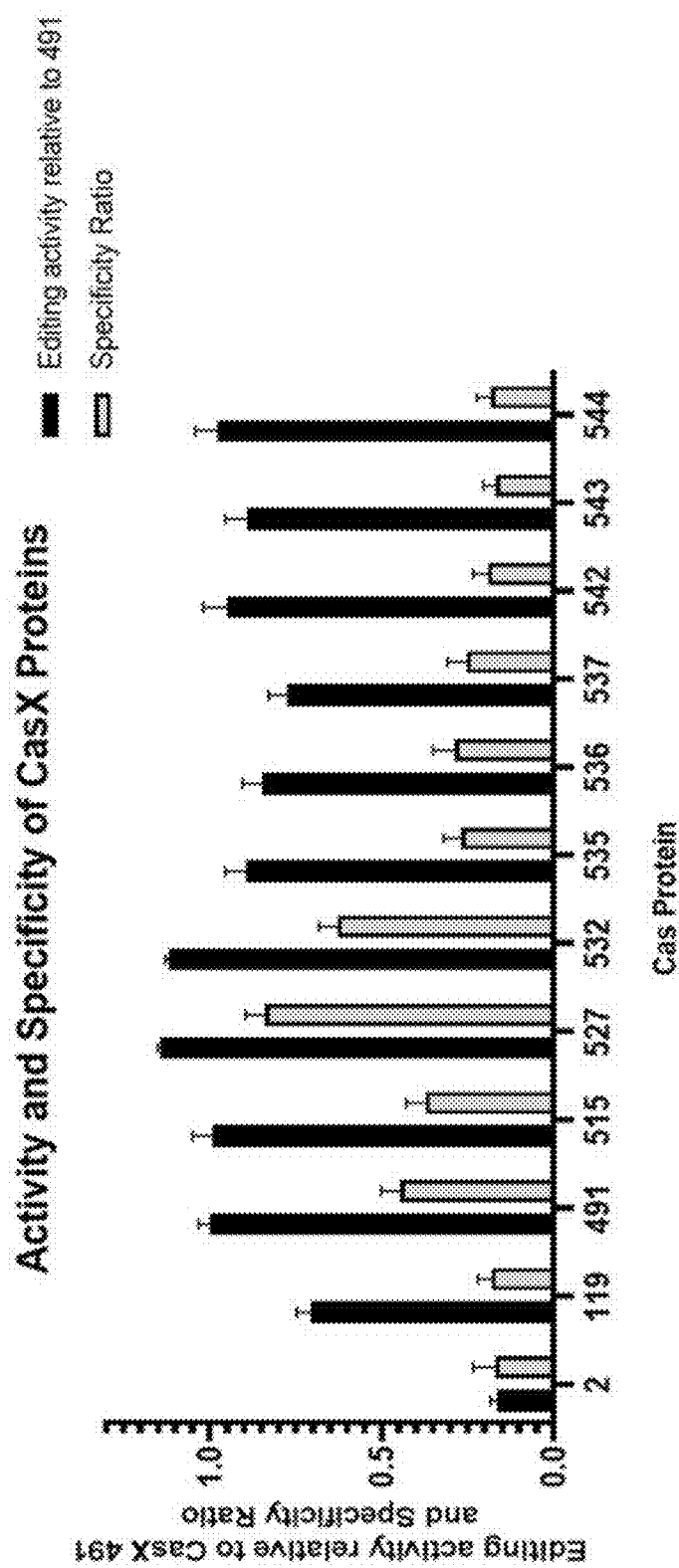

FIG. 43 is a bar plot showing the average editing efficiency relative to CasX 491 as well as the average Specificity ratio of select CasX nucleases, as described in Example 20.

Figure 44:
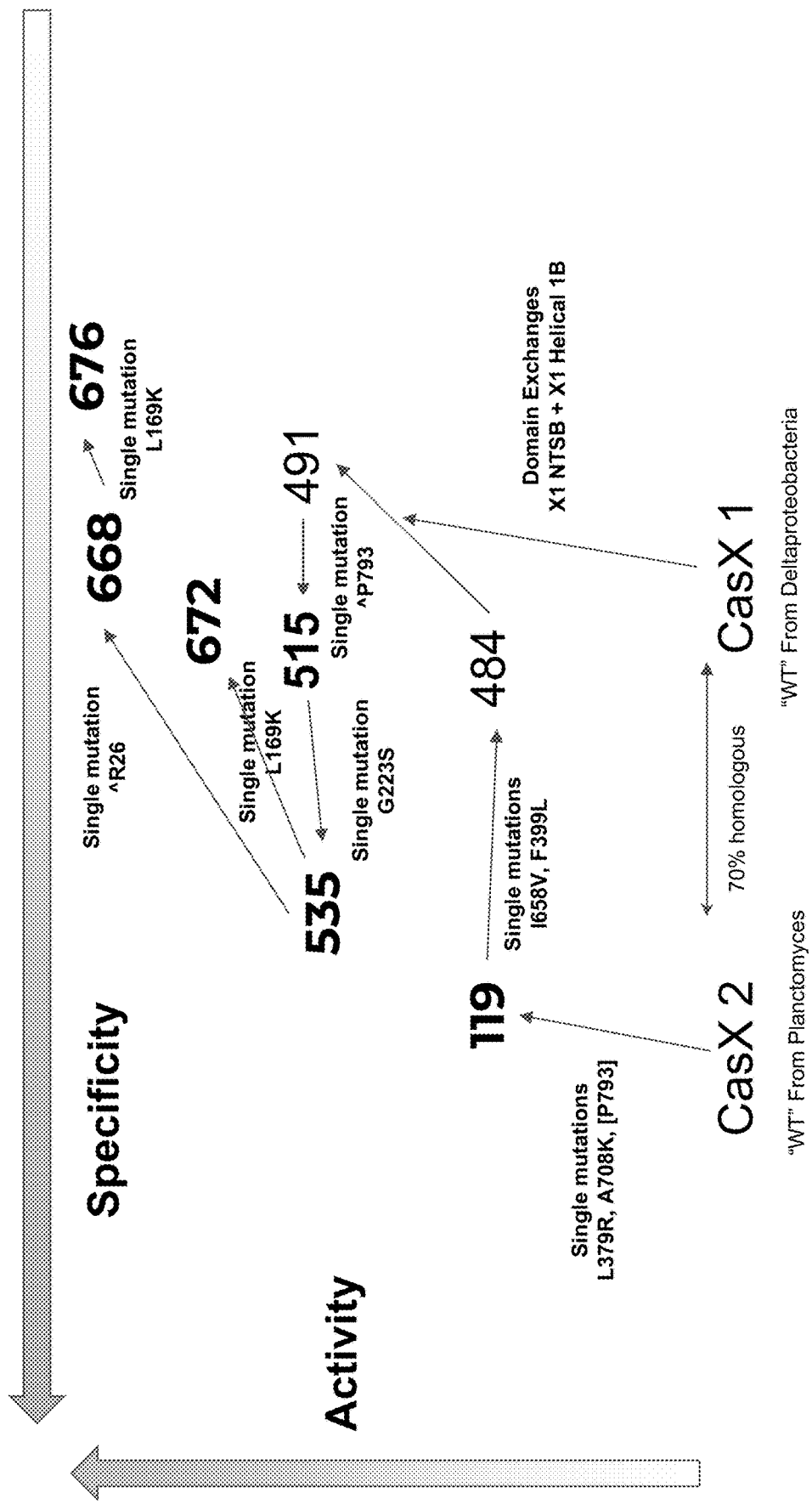

FIG. 44 is a flow-chart illustrating the qualitative relationship between tested combinations of mutations and their effect on both activity and specificity of the resulting CasX variants, as described in Example 21.

FIG. 45A show the results of AAV-mediated editing assays comparing gRNA scaffold 235 to scaffold 174 and guide 11.30 and 11.31 at the endogenous mouse Rho exon 1 locus in mNPCs over a range of MOI, as described in Example 21.

FIG. 45B shows the editing results as fold-change in editing levels for scaffold 235 relative to guide 174 (set to 1.0) with spacer 11.30 in cells infected at a 5.0e+5 MOI, as described in Example 21.

FIG. 46 is a schematic showing the modifications made in the extended stem loop in gRNA variant 175 that were incorporated into gRNA variant 235. sgRNA 175 extended stem loop: SEQ ID NO: 1285; sgRNA 235 extended stem loop: SEQ ID NO: 1286.

Figure 47:
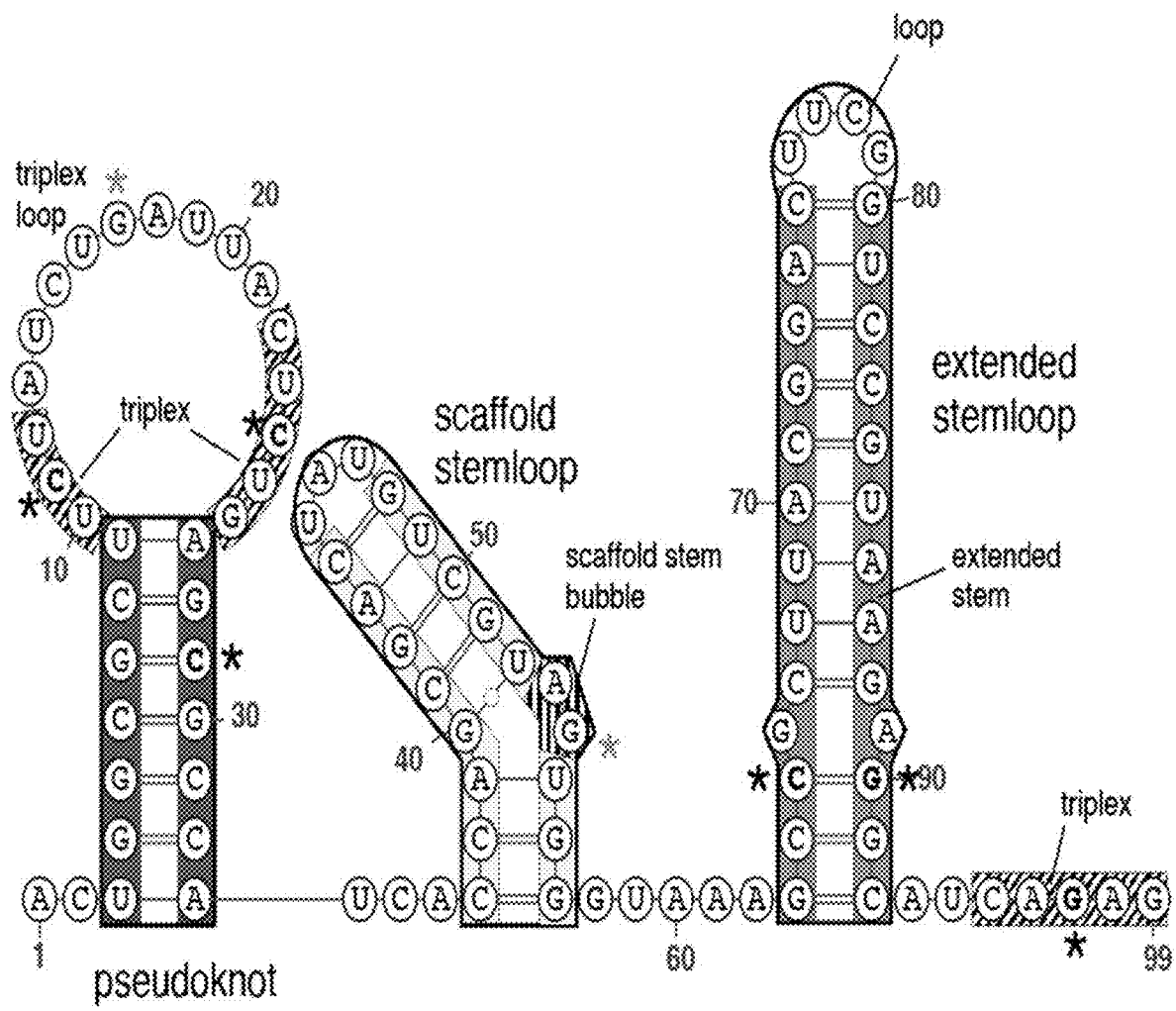

FIG. 47 is a schematic of gRNA variant 235, indicated the modifications in the triplex, the scaffold stem bubble, and the extended stem loop, relative to gRNA variants 174 and 175. Pseudoknot and triplex loop: SEQ ID NO: 1287; scaffold stem and extended stem: SEQ ID NO: 1288.

FIG. 48 is a schematic illustrating the positions of the bases within the MS2 hairpin, as described in Example 23. MS2 sequence in figure: SEQ ID NO: 1289.

Figure 49:
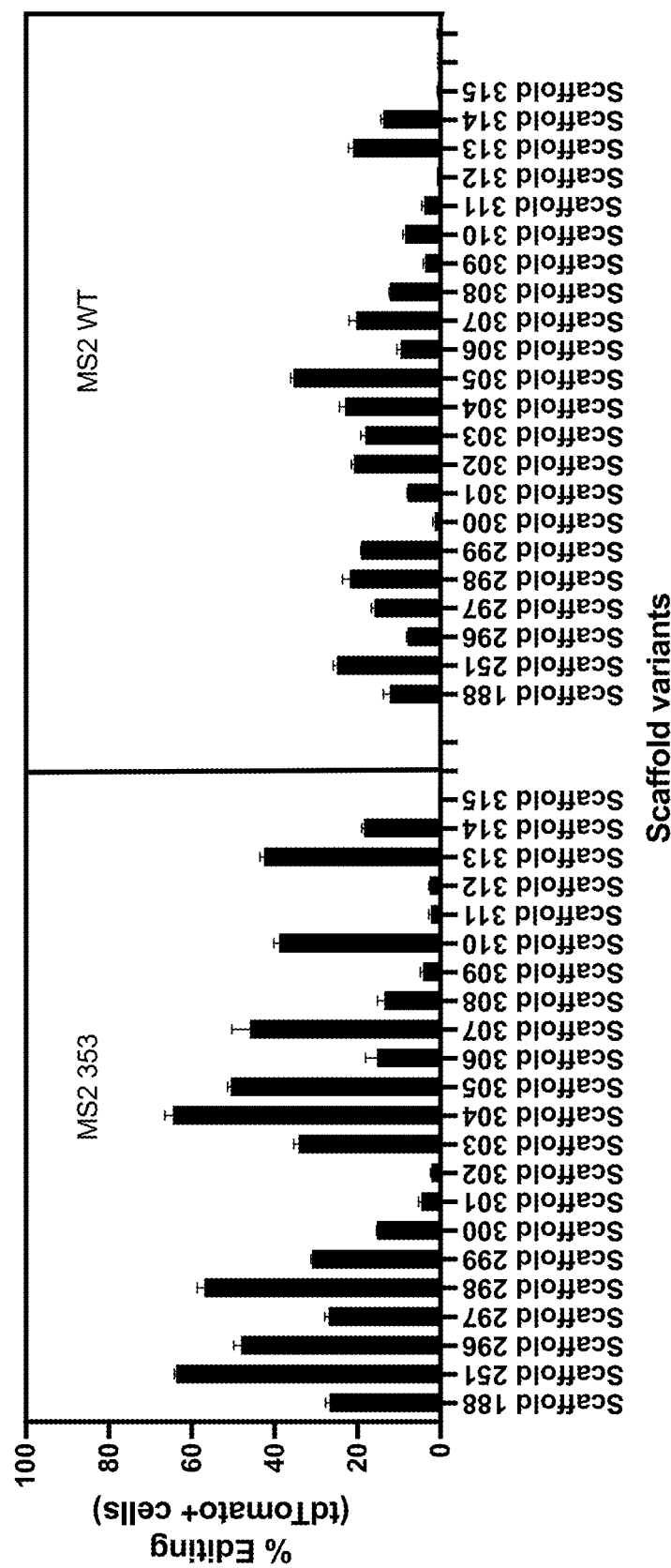

FIG. 49 is a graph of percent editing at the tdTomato locus measured by tdTomato fluorescence for XDPs packaged with the indicated scaffold variants, with gRNA scaffold 188 and 251 serving as base variants, as described in Example 23. Two MS2 versions (MS2 353 and MS2 WT) were used.

Figure 50:
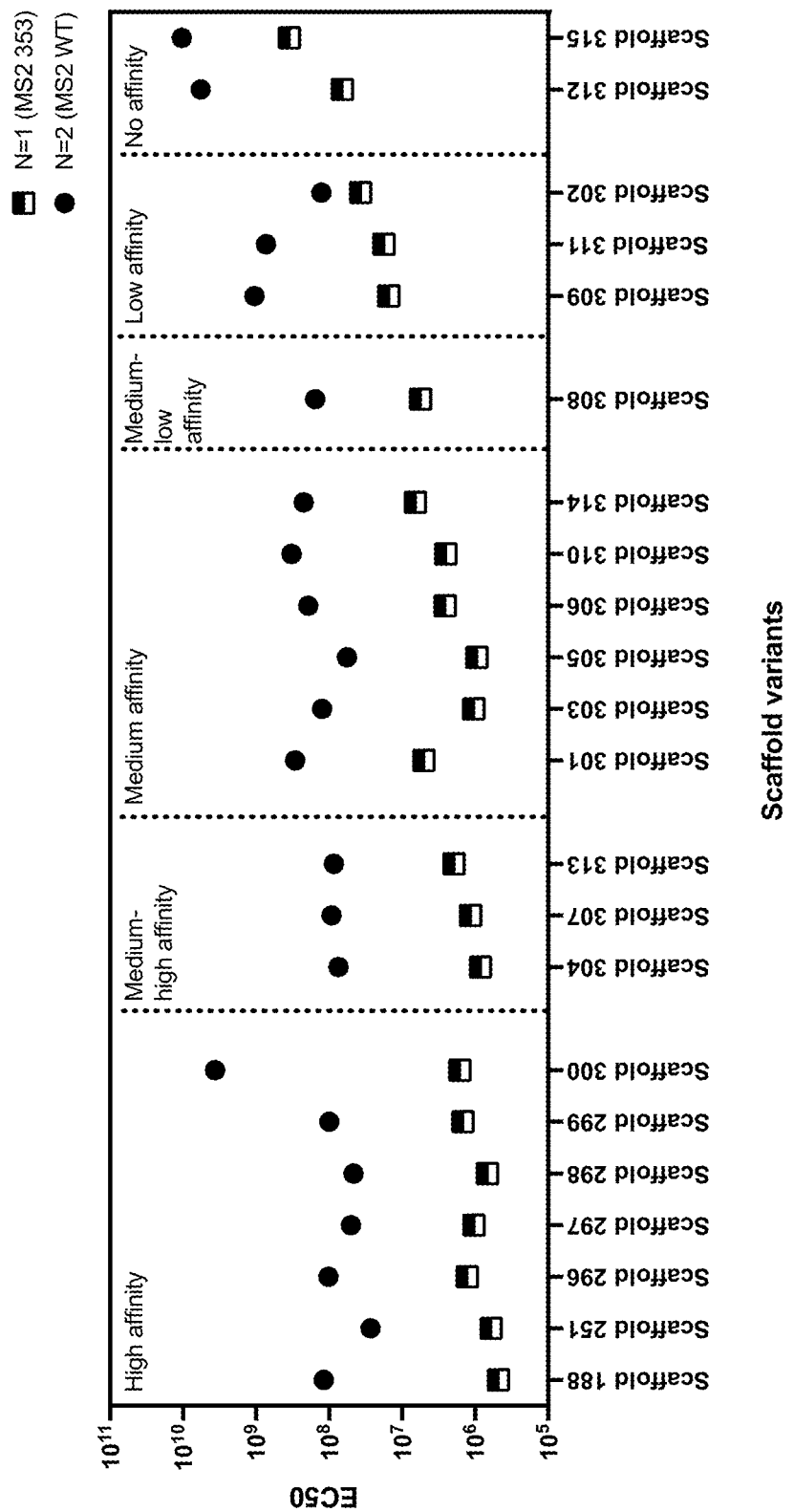

FIG. 50 shows the improvements in EC50 values, determined using the NanoSight, for editing at the tdTomato locus in NPCs, relative to titers, for XDPs packaged with the indicated gRNA scaffold variants, with Scaffold 188 and 251 serving as base controls, as described in Example 23. Two MS2 versions, MS2 353 and MS2 wild type (WT), were used.

Figure 51:
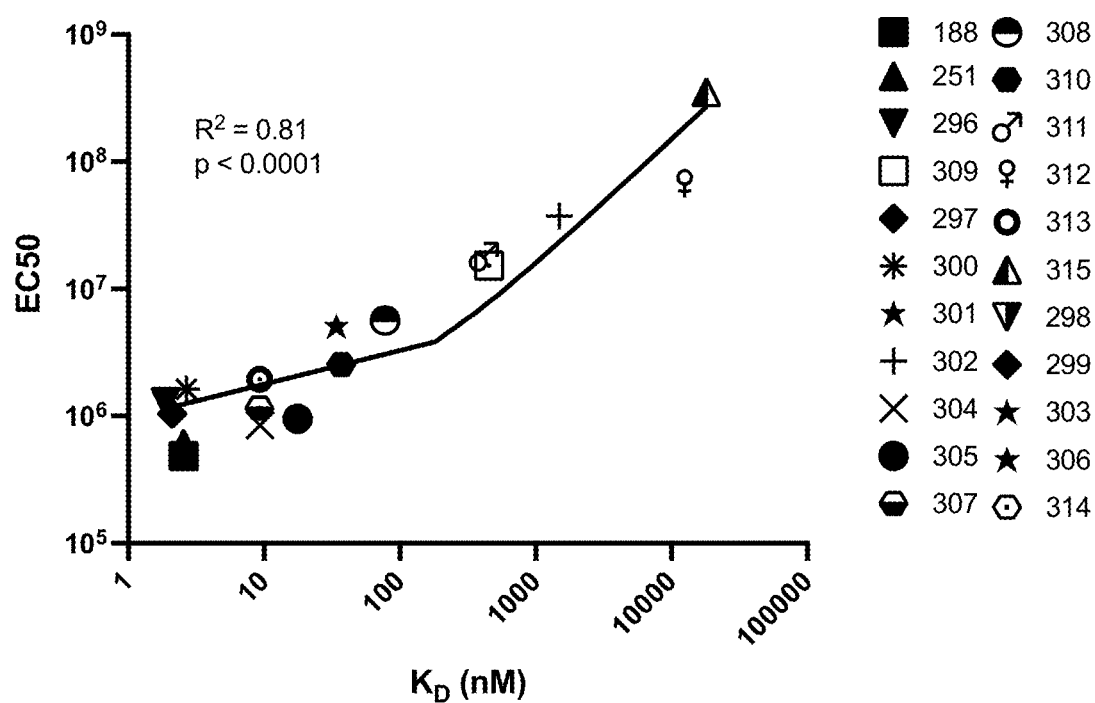

FIG. 51 shows the correlation between MS2 hairpin affinity ($K_D$) and EC50 for XDPs packaged with the depicted gRNA scaffold variants, as described in Example 23.

Figure 52:
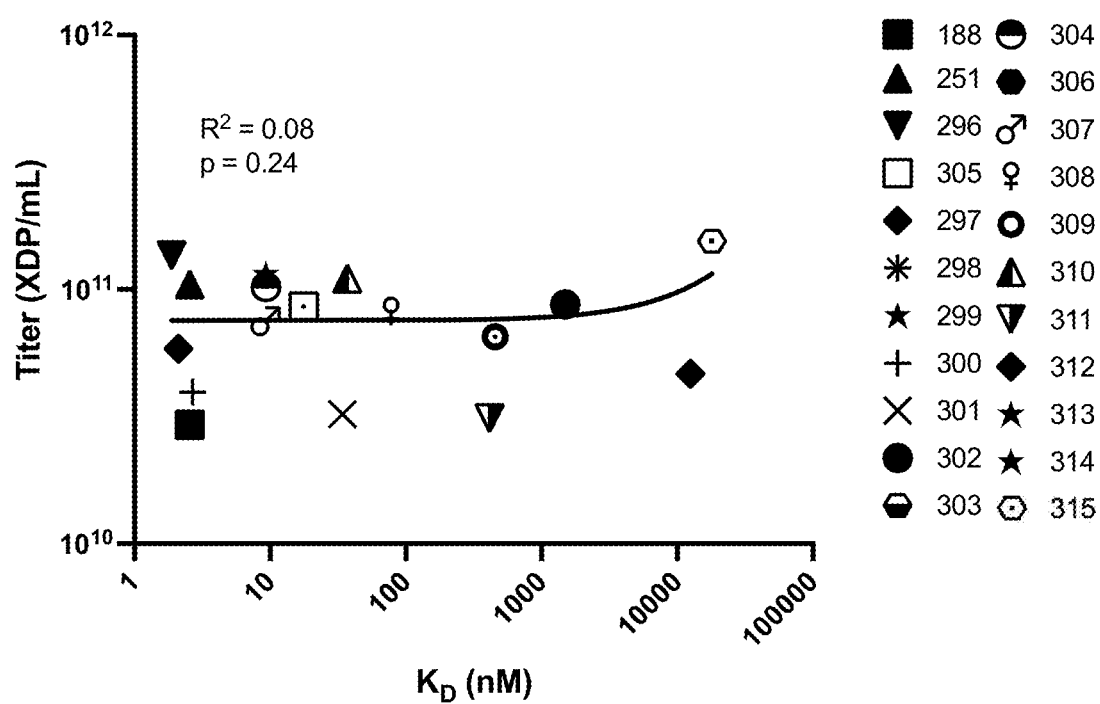

FIG. 52 shows the correlation between MS2 hairpin affinity ($K_D$) and titer for XDPs packaged with the depicted gRNA scaffold variants, as described in Example 23.

DETAILED DESCRIPTION

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Unless otherwise defined, all technical and scientific terms used herein have the same meaning as commonly understood by one of ordinary skill in the art to which this invention belongs. Although methods and materials similar or equivalent to those described herein can be used in the practice or testing of the present embodiments, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid sequence to be specifically hybridizable; it can have at least about 70%, at least about 80%, or at least about 90%, or at least about 95% sequence identity and still hybridize to the target nucleic acid sequence. Moreover, a polynucleotide may hybridize over one or more segments such that intervening or adjacent segments are not involved in the hybridization event (e.g., a loop structure or hairpin structure, a 'bulge', 'bubble' and the like).

A "gene," for the purposes of the present disclosure, includes a DNA region encoding a gene product (e.g., a protein, RNA), as well as all DNA regions which regulate the production of the gene product, whether or not such regulatory sequences are adjacent to coding and/or transcribed sequences. Accordingly, a gene may include accessory element sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed as well as the complementary strand containing the anticodons.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "adjacent to" with respect to polynucleotide or amino acid sequences refers to sequences that are next to, or adjoining each other in a polynucleotide or polypeptide. The skilled artisan will appreciate that two sequences can be considered to be adjacent to each other and still encompass a limited amount of intervening sequence, e.g., 1, 2, 3, 4, 5, 6, 7, 8, 9 or 10 nucleotides or amino acids.

The term "accessory element" is used interchangeably herein with the term "accessory sequence," and is intended to include, inter alia, polyadenylation signals (poly(A) signal), enhancer elements, introns, posttranscriptional regulatory elements (PTREs), nuclear localization signals (NLS), deaminases, DNA glycosylase inhibitors, additional promoters, factors that stimulate CRISPR-mediated homology-directed repair (e.g. in cis or in trans), activators or repressors of transcription, self-cleaving sequences, and fusion domains, for example a fusion domain fused to a CRISPR protein. It will be understood that the choice of the appropriate accessory element or elements will depend on the encoded component to be expressed (e.g., protein or RNA) or whether the nucleic acid comprises multiple components that require different polymerases or are not intended to be expressed as a fusion protein.

The term "promoter" refers to a DNA sequence that contains a transcription start site and additional sequences to facilitate polymerase binding and transcription. Exemplary eukaryotic promoters include elements such as a TATA box, and/or B recognition element (BRE) and assists or promotes the transcription and expression of an associated transcribable polynucleotide sequence and/or gene (or transgene). A promoter can be synthetically produced or can be derived from a known or naturally occurring promoter sequence or another promoter sequence. A promoter can be proximal or distal to the gene to be transcribed. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive, developmental, tissue-specific, inducible, etc. A promoter can also be classified according to its strength. As used in the context of a promoter, "strength" refers to the rate of transcription of the gene controlled by the promoter. A "strong" promoter means the rate of transcription is high, while a "weak" promoter means the rate of transcription is relatively low.

A promoter of the disclosure can be a Polymerase II (Pol II) promoter. Polymerase II transcribes all protein coding and many non-coding genes. A representative Pol II promoter includes a core promoter, which is a sequence of about 100 base pairs surrounding the transcription start site, and serves as a binding platform for the Pol II polymerase and associated general transcription factors. The promoter may contain one or more core promoter elements such as the TATA box, BRE, Initiator (INR), motif ten element (MTE), downstream core promoter element (DPE), downstream core element (DCE), although core promoters lacking these elements are known in the art.

A promoter of the disclosure can be a Polymerase III (Pol III) promoter. Pol III transcribes DNA to synthesize small ribosomal RNAs such as the 5S rRNA, tRNAs, and other small RNAs. Representative Pol III promoters use internal control sequences (sequences within the transcribed section of the gene) to support transcription, although upstream elements such as the TATA box are also sometimes used. All Pol III promoters are envisaged as within the scope of the instant disclosure.

The term "enhancer" refers to regulatory DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

As used herein, a "post-transcriptional regulatory element (PRE)," such as a hepatitis PRE, refers to a DNA sequence that, when transcribed creates a tertiary structure capable of exhibiting post-transcriptional activity to enhance or promote expression of an associated gene operably linked thereto.

As used herein, a "post-transcriptional regulatory element (PTRE)," such as a hepatitis PTRE, refers to a DNA sequence that, when transcribed creates a tertiary structure capable of exhibiting post-transcriptional activity to enhance or promote expression of an associated gene operably linked thereto.

"Recombinant," as used herein, means that a particular nucleic acid (DNA or RNA) is the product of various combinations of cloning, restriction, and/or ligation steps resulting in a construct having a structural coding or noncoding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant polypeptide" or "recombinant protein" refers to a polypeptide or protein which is not naturally occurring, e.g., is made by the artificial combination of two otherwise separated segments of amino sequence through human intervention. Thus, e.g., a protein that comprises a heterologous amino acid sequence is recombinant.

As used herein, the term "contacting" means establishing a physical connection between two or more entities. For example, contacting a target nucleic acid with a guide nucleic acid means that the target nucleic acid and the guide nucleic acid are made to share a physical connection; e.g., can hybridize if the sequences share sequence similarity.

"Dissociation constant", or "$K_a$", are used interchangeably and mean the affinity between a ligand "L" and a protein "P"; i.e., how tightly a ligand binds to a particular protein. It can be calculated using the formula $K_d=[L][P]/[LP]$, where [P], [L] and [LP] represent molar concentrations of the protein, ligand and complex, respectively.

The disclosure provides systems and methods useful for editing a target nucleic acid sequence. As used herein "editing" is used interchangeably with "modifying" and includes but is not limited to cleaving, nicking, deleting, knocking in, knocking out, and the like.

By "cleavage" it is meant the breakage of the covalent backbone of a target nucleic acid molecule (e.g., RNA, DNA). Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events.

The term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant sequence. The term "knock-down" as used herein refers to reduction in the expression of a gene or its gene product(s). As a result of a gene knock-down, the protein activity or function may be attenuated or the protein levels may be reduced or eliminated.

As used herein, "homology-directed repair" (HDR) refers to the form of DNA repair that takes place during repair of double-strand breaks in cells. This process requires nucleotide sequence homology, and uses a donor template to repair or knock-out a target DNA, and leads to the transfer of genetic information from the donor to the target. Homology-directed repair can result in an alteration of the sequence of the target sequence by insertion, deletion, or mutation if the donor template differs from the target DNA sequence and part or all of the sequence of the donor template is incorporated into the target DNA.

As used herein, "non-homologous end joining" (NHEJ) refers to the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

As used herein "micro-homology mediated end joining" (MMEJ) refers to a mutagenic DSB repair mechanism, which always associates with deletions flanking the break sites without the need for a homologous template (in contrast to homology-directed repair, which requires a homologous sequence to guide repair). MMEJ often results in the loss (deletion) of nucleotide sequence near the site of the double-strand break. A polynucleotide or polypeptide has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an "insert", may be attached so as to bring about the replication or expression of the attached segment in a cell.

The term "naturally-occurring" or "unmodified" or "wild type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a wild-type or reference amino acid sequence or to a wild-type or reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., in a cell line), which eukaryotic or prokaryotic cells are used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector.

The term "tropism" "as used herein refers to preferential entry of the virus like particle (XDP, sometimes also referred to herein as XDP) into certain cell or tissue type(s) and/or preferential interaction with the cell surface that facilitates entry into certain cell or tissue types, optionally and preferably followed by expression (e.g., transcription and, optionally, translation) of sequences carried by the XDP into the cell.

The terms "pseudotype" or "pseudotyping" as used herein, refers to viral envelope proteins that have been substituted with those of another virus possessing preferable characteristics. For example, HIV can be pseudotyped with vesicular stomatitis virus G-protein (VSV-G) envelope proteins (amongst others, described herein, below), which allows HIV to infect a wider range of cells because HIV envelope proteins target the virus mainly to CD4+ presenting cells.

The term "tropism factor" as used herein refers to components integrated into the surface of an XDP that provides tropism for a certain cell or tissue type. Non-limiting examples of tropism factors include glycoproteins, antibody fragments (e.g., scFv, nanobodies, linear antibodies, etc.), receptors and ligands to target cell markers.

A "target cell marker" refers to a molecule expressed by a target cell including but not limited to cell-surface receptors, cytokine receptors, antigens, tumor-associated antigens, glycoproteins, oligonucleotides, enzymatic substrates, antigenic determinants, or binding sites that may be present in the on the surface of a target tissue or cell that may serve as ligands for an antibody fragment or glycoprotein tropism factor.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

The term "antibody," as used herein, encompasses various antibody structures, including but not limited to monoclonal antibodies, polyclonal antibodies, multispecific antibodies (e.g., bispecific antibodies), nanobodies, single domain antibodies such as VHH antibodies, and antibody fragments so long as they exhibit the desired antigen-binding activity or immunological activity. Antibodies represent a large family of molecules that include several types of molecules, such as IgD, IgG, IgA, IgM and IgE.

An "antibody fragment" refers to a molecule other than an intact antibody that comprises a portion of an intact antibody and that binds the antigen to which the intact antibody binds. Examples of antibody fragments include but are not limited to Fv, Fab, Fab', Fab'-SH, F(ab')2, diabodies, single chain diabodies, linear antibodies, a single domain antibody, a single domain camelid antibody, single-chain variable fragment (scFv) antibody molecules, and multispecific antibodies formed from antibody fragments.

As used herein, "treatment" or "treating," are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a drug or a biologic, alone or as a part of a composition, that is capable of having any detectable, beneficial effect on any symptom, aspect, measured parameter or characteristics of a disease state or condition when administered in one or repeated doses to a subject such as a human or an experimental animal. Such effect need not be absolute to be beneficial.

As used herein, "administering" means a method of giving a dosage of a compound (e.g., a composition of the disclosure) or a composition (e.g., a pharmaceutical composition) to a subject.

A "subject" is a mammal. Mammals include, but are not limited to, domesticated animals, non-human primates, humans, dogs, rabbits, mice, rats and other rodents.

All publications, patents, and patent applications mentioned in this specification are herein incorporated by ref-

I. General Methods

The practice of the present invention employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., Harbor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the disclosure, which are, for clarity, described in the context of separate embodiments, may also be provided in combination in a single embodiment. In other cases, various features of the disclosure, which are, for brevity, described in the context of a single embodiment, may also be provided separately or in any suitable sub-combination. It is intended that all combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

II. Systems for Genetic Editing and Gene-Editing Pairs

In a first aspect, the present disclosure provides systems comprising a Class 2, Type V CRISPR nuclease protein and one or more guide nucleic acids (e.g. gRNA) for use in modifying or editing a target nucleic acid of a gene, inclusive of coding and non-coding regions. Generally, any portion of a gene can be targeted using the programmable systems and methods provided herein. As used herein, a "system," such as the systems comprising a CRISPR nuclease protein and one or more gRNAs of the disclosure as gene editing pairs, as well as nucleic acids encoding the CRISPR nuclease proteins and gRNA and vectors comprising the nucleic acids or CRISPR nuclease protein and one or more gRNAs the disclosure, is used interchangeably with term "composition."

In some embodiments, the disclosure provides systems specifically designed to modify the target nucleic acid of a gene in eukaryotic cells; either in vitro, ex vivo, or in vivo in a subject. Generally, any portion of the gene can be targeted using the programmable systems and methods provided herein. In some embodiments, the CRISPR nuclease is a Class 2, Type V nuclease. Although members of Class 2 Type V CRISPR-Cas nucleases have differences, they share some common characteristics that distinguish them from the Cas9 systems. Firstly, the Type V nucleases possess an RNA-guided single effector containing a RuvC domain but no HNH domain, and they recognize a TC motif PAM 5' upstream to the target region on the non-targeted strand, which is different from Cas9 systems which rely on G-rich PAM at 3' side of target sequences. Type V nucleases generate staggered double-stranded breaks distal to the PAM sequence, unlike Cas9, which generates a blunt end in the proximal site close to the PAM. In addition, Type V nucleases degrade ssDNA in trans when activated by target dsDNA or ssDNA binding in cis. In some embodiments, the disclosure provides Class 2, Type V nuclease selected from the group consisting of Cas12a, Cas12b, Cas12c, Cas12d (CasY), Cas12j, Cas12k, C2c4, C2c8, C2c5, C2c10, C2c9, CasZ, and CasX. In some embodiments, the disclosure provides systems comprising one or more CasX variant proteins and one or more guide nucleic acid (gRNA) variants as a CasX:gRNA system.

Provided herein are systems comprising a Class 2, Type V protein and a gRNA variant, referred to herein as a gene editing pair. In some embodiments, the Class 2, Type V variant is a CasX variant, such as, but not limited to the sequence of SEQ ID NO: 416. The terms CasX variant protein and CasX variant are used interchangeably herein. In some embodiments, the gRNA is a variant of another gRNA, such as, but not limited to the sequences of SEQ ID NOS: 2238 and 2239. A gRNA and CasX protein can bind together via non-covalent interactions to form a gene editing pair complex, referred to herein as a ribonucleoprotein (RNP) complex. In some embodiments, the use of a pre-complexed CasX:gRNA RNP confers advantages in the delivery of the system components to a cell or target nucleic acid for editing of the target nucleic acid. In the RNP, the gRNA can provide target specificity to the RNP complex by including a targeting sequence (or "spacer") having a nucleotide sequence that is complementary to a sequence of a target nucleic acid. In the RNP, the CasX protein of the pre-complexed CasX: gRNA provides the site-specific activity and is guided to a target site (and further stabilized at a target site) within a target nucleic acid sequence to be modified by virtue of its association with the gRNA. The CasX variant protein of the RNP complex provides the site-specific activities of the complex such as binding, cleavage, or nicking of the target sequence by the CasX protein. Provided herein are systems and cells comprising the CasX variant proteins, gRNA variants, and CasX:gRNA gene editing pairs of any combination of the CasX variant and gRNA variant embodiments described herein, as well as delivery modalities comprising the CasX:gRNA. Each of these components and their use in the editing of the target nucleic acid of a gene is described herein, below.

In some embodiments, the disclosure provides systems of gene editing pairs comprising a CasX variant protein selected from any one of CasX variant proteins of Table 3 (SEQ ID NOS: 247-592 and 1147-1231, or a sequence having at least about 85%, at least about 90%, or at least about 95%, or at least about 95%, or at least about 96%, or at least about 97%, or at least about 98%, or at least about 99% sequence identity thereto, while the gRNA is a gRNA variant as described herein (e.g., SEQ ID NOS: 2101-2332 and 2353-2398 set forth in Table 2), or sequence variants having at least 60%, or at least 70%, at least about 80%, or at least about 90%, or at least about 95% sequence identity thereto, wherein the gRNA comprises a targeting sequence complementary to the target nucleic acid. In some embodiments, the disclosure provides systems of gene editing pairs comprising a CasX variant protein selected from any one of CasX variant proteins of Table 3 (SEQ ID NOS: 270-592 and 1147-1231), while the gRNA is a gRNA variant as described herein (e.g., SEQ ID NOS: 2238-2332 and 2353-2398), wherein the gRNA comprises a targeting sequence complementary to the target nucleic acid. In some embodiments, the disclosure provides systems of gene editing pairs comprising a CasX variant protein selected from any one of CasX variant proteins of Table 3 (SEQ ID NOS: 415-592 and 1147-1231), while the gRNA is a gRNA variant as described herein (e.g., SEQ ID NOS: 2281-2332 and 2353-2398), wherein the gRNA comprises a targeting sequence complementary to the target nucleic acid. In other embodiments, the disclosure provides systems of a gene editing pair comprising the CasX variant protein, a first gRNA variant as described herein; e.g., SEQ ID NOS: 2101-2332 or 2353-2398 set forth in Table 2) with a targeting sequence, and a second gRNA variant, wherein the second gRNA variant has a targeting sequence complementary to a different or overlapping portion of the target nucleic acid compared to the targeting sequence of the first gRNA. In other embodiments, the disclosure provides systems of a gene editing pair comprising the CasX variant protein, a first gRNA variant as described herein; e.g., SEQ ID NOS: 2101-2332 or 2353-2398) with a targeting sequence, and a second gRNA variant, wherein the second gRNA variant has a targeting sequence complementary to a different or overlapping portion of the target nucleic acid compared to the targeting sequence of the first gRNA. In other embodiments, the disclosure provides systems of a gene editing pair comprising the CasX variant protein, a first gRNA variant as described herein; e.g., SEQ ID NOS: 2281-2332 or 2353-2398) with a targeting sequence, and a second gRNA variant, wherein the second gRNA variant has a targeting sequence complementary to a different or overlapping portion of the target nucleic acid compared to the targeting sequence of the first gRNA. In some embodiments of the CasX:gRNA gene editing pairs of the disclosure, the CasX variant protein is selected from the group consisting of CasX variant proteins 515, 528, 529, 534-539, 668, 672, and 678 of Table 3 (SEQ ID NOS: 416, 428, 434-439, 567, 570 and 576) and the sgRNA variant is selected from the group consisting of gRNA variants 229-237 of Table 2 (SEQ ID NOS: 2286-2294). In a particular embodiment, the gene editing pair comprises a CasX variant protein selected from any one of CasX variant proteins 668 (SEQ ID NO: 567), 672 (SEQ ID NO: 570) or 676 (SEQ ID NO: 574) and gRNA variant 235 (SEQ ID NO: 2292).

In some embodiments, the gene editing pair is capable of associating together to form a ribonuclear protein complex (RNP). In other embodiments, the gene editing pair is associated together in a ribonuclear protein complex (RNP). In some embodiments, the RNP of the gene editing pair is capable of binding and cleaving the double strand of a target nucleic acid, including a coding sequence, a complement of a coding sequence, a non-coding sequence, and to regulatory elements. In some embodiments, the RNP of the gene editing pair is capable of binding a target nucleic acid and generating one or more single-stranded nicks in the target nucleic acid. In some embodiments, the RNP of the gene editing pair is capable of binding a target nucleic acid but is not capable of cleaving the target nucleic acid.

In some embodiments, the variant gene editing pair has one or more improved characteristics compared to a reference gene editing pair comprising a reference CasX protein of SEQ ID NO: 1, SEQ ID NO: 2, or SEQ ID NO: 3 and a reference gRNA of SEQ ID NO: 5 or SEQ ID NO: 4. In other embodiments, the variant gene editing pair of a CasX variant and a gRNA variant has one or more improved characteristics compared to a gene editing pair comprising a CasX variant from which the variant was derived (e.g., CasX 515, SEQ ID NO: 416) and the gRNA variant from which the variant was derived (e.g., gRNA scaffold 174 (SEQ ID NO: 2238) or 175 (SEQ ID NO: 2239). In the foregoing embodiments, the one or more improved characteristics can be assayed in an in vitro assay under comparable conditions for the gene editing pair and the reference CasX and reference gRNA. Exemplary improved characteristics, as described herein, may, in some embodiments, include CasX:gRNA RNP complex stability, increased binding affinity between the CasX and gRNA, improved kinetics of RNP complex formation, higher percentage of cleavage-competent RNP, increased RNP binding affinity to the target nucleic acid, unwinding of the target nucleic acid, increased editing activity, increased editing efficiency, increased editing specificity for the target nucleic acid, decreased off-target editing or cleavage, increased activity of the nuclease, increased target strand loading for double strand cleavage, decreased target strand loading for single strand nicking, increased binding of the non-target strand of DNA, or increased resistance to nuclease activity. In the foregoing embodiments, the improvement is at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the characteristic of a reference CasX protein and reference gRNA pair, or to the characterisitics of the CasX variant and gRNA variant from which the gene editing pair was derived. In other cases, the one or more of the improved characteristics may be improved about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to a reference gene editing pair, or to the characterisitics of the CasX variant and gRNA variant from which the gene editing pair was derived. In other cases, the one or more of the improved characteristics may be improved about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold or more improved relative to a reference gene editing pair, or to the characterisitics of the CasX variant and gRNA variant from which the gene editing pair was derived.

In some embodiments, wherein the gene editing pair comprises both a CasX variant protein and a gRNA variant as described herein, the one or more characteristics of the gene editing pair is improved beyond what can be achieved by varying the CasX protein or the gRNA alone. In some embodiments, the CasX variant protein and the gRNA variant act additively to improve one or more characteristics of the gene editing pair. In some embodiments, the CasX variant protein and the gRNA variant act synergistically to improve one or more characteristics of the gene editing pair. In the foregoing embodiments, the improvement is at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the characteristic of a reference CasX protein and reference gRNA pair, or to the characterisitics of the CasX variant and gRNA variant from which the gene editing pair was derived.

In some embodiments, the disclosure provides compositions of gene editing pairs of any of the embodiments disclosed herein for use as a medicament for the treatment of a subject having a disease.

In other embodiments, the systems of the disclosure comprise one or more CasX variant proteins, one or more guide nucleic acids (gRNA) and one or more donor template nucleic acids comprising a nucleic acid encoding a portion of a gene wherein the donor template nucleic acid comprises a wild-type sequence for correction of a mutation, or comprises a deletion, an insertion, or a mutation of one or more nucleotides in comparison to a wild-type genomic nucleic acid sequence for knocking-down or knocking-out the gene.

In other embodiments, the disclosure provides vectors encoding or comprising the CasX variant, gRNA variant, and, optionally, donor templates for the production and/or delivery of the CasX:gRNA systems. Also provided herein are methods of making CasX variant proteins and gRNA variants, as well as methods of using the CasX variants and gRNA variants, including methods of gene editing and methods of treatment. The CasX variant proteins and gRNA variant components of the CasX:gRNA systems and their features, as well as the delivery modalities and the methods of using the systems are described more fully, below.

The donor templates of the CasX:gRNA systems are designed depending on whether they are utilized to correct mutations in a target gene or insert a transgene at a different locus in the genome (a "knock-in"), or are utilized to disrupt the expression of a gene product that is aberrant; e.g., it comprises one or more mutations that reduce expression of the gene product or rendering the protein dysfunctional (a "knock-down" or "knock-out"). In some embodiments, the donor template is a single stranded DNA template or a single stranded RNA template. In other embodiments, the donor template is a double stranded DNA template. In some embodiments, the CasX:gRNA systems utilized in the editing of the target nucleic acid comprises a donor template having all or at least a portion of an open reading frame of a gene in the target nucleic acid for insertion of a corrective, wild-type sequence to correct a defective protein. In other cases, the donor template comprises all or a portion of a wild-type gene for insertion at a different locus in the genome for expression of the gene product. In still other cases, a portion of the gene can be inserted upstream ('5) of the mutation in the target nucleic acid, wherein the donor template gene portion spans to the C-terminus of the gene or to the 3' end of the sequence having the mutation, resulting, upon its insertion into the target nucleic acid, in expression of a functional gene product.

In some embodiments, the donor template sequence comprises a non-homologous sequence flanked by two regions of homology 5' and 3' to the break sites of the target nucleic acid (i.e., homologous arms), facilitating insertion of the non-homologous sequence at the target region which can be mediated by homology directed repair (HDR) or homology-independent targeted integration (HITI). The exogenous donor template inserted by HITI can be any length, for example, a relatively short sequence of between 10 and 50 nucleotides in length, or a longer sequence of about 50-1000 nucleotides in length. The lack of homology can be, for example, having no more than 20-50% sequence identity and/or lacking in specific hybridization at low stringency. In other cases, the lack of homology can further include a criterion of having no more than 5, 6, 7, 8, or 9 bp identity. In such cases, the use of homologous arms facilitates the insertion of the non-homologous sequence at the break site(s) introduced by the nuclease. In some embodiments, the donor template polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000 nucleotides. In other embodiments, the donor template comprises at least about 10 to about 15,000 nucleotides, or at least about 100 to about 10,000 nucleotides, or at least about 400 to about 8,000 nucleotides, or at least about 600 to about 5000 nucleotides, or at least about 1000 to about 2000 nucleotides. The donor template sequence may comprise certain sequence differences as compared to the genomic sequence; e.g., restriction sites, nucleotide polymorphisms, selectable markers (e.g., drug resistance genes, fluorescent proteins, enzymes etc.), etc., which may be used to assess for successful insertion of the donor nucleic acid at the cleavage site or in some cases may be used for other purposes (e.g., to signify expression at the targeted genomic locus). Alternatively, these sequence differences may include flanking recombination sequences such as FLPs, loxP sequences, or the like, that can be activated at a later time for removal of the marker sequence.

III. Guide Nucleic Acids of the Systems for Genetic Editing

In another aspect, the disclosure relates to specifically-designed guide ribonucleic acids (gRNA) comprising a targeting sequence (also referred to herein as a spacer) complementary to (and are therefore able to hybridize with) a target nucleic acid sequence of a gene that have utility, when complexed with a CRISPR nuclease, in genome editing of the target nucleic acid in a cell. It is envisioned that in some embodiments, multiple gRNAs are delivered in the systems for the modification of a target nucleic acid. For example, a pair of gRNAs with targeting sequences to different or overlapping regions of the target nucleic acid sequence can be used, when each is complexed with a CRISPR nuclease, in order to bind and cleave at two different or overlapping sites within the gene, which is then edited by non-homologous end joining (NHEJ), homology-directed repair (HDR), homology-independent targeted integration (HITI), micro-homology mediated end joining (MMEJ), single strand annealing (SSA) or base excision repair (BER).

In some embodiments, the disclosure provides gRNAs utilized in the systems that have utility in genome editing a gene in a eukaryotic cell. In a particular embodiment, the gRNA of the systems are capable of forming a complex with a CRISPR nuclease; a ribonucleoprotein (RNP) complex, described more fully, below.

a. Reference gRNA and gRNA Variants

As used herein, a "reference gRNA" refers to a CRISPR guide nucleic acid comprising a wild-type sequence of a naturally-occurring gRNA. In some embodiments, a reference gRNA of the disclosure may be subjected to one or more mutagenesis methods, such as the mutagenesis methods described herein in the Examples (e.g., Example 13, as well as in PCT/US20/36506 and WO2020247883A2, incorporated by reference herein), which may include Deep Mutational Evolution (DME), deep mutational scanning (DMS), error prone PCR, cassette mutagenesis, random mutagenesis, staggered extension PCR, gene shuffling, or domain swapping, in order to generate one or more guide nucleic acid variants (referred to herein as "gRNA variant") with enhanced or varied properties relative to the reference gRNA. gRNA variants also include variants comprising one or more exogenous sequences, for example fused to either the 5' or 3' end, or inserted internally. The activity of reference gRNAs or the variant from which it was derived may be used as a benchmark against which the activity of gRNA variants are compared, thereby measuring improvements in function or other characteristics of the gRNA variants. In other embodiments, a reference gRNA or a gRNA variant may be subjected to one or more deliberate, specifically-targeted mutations in order to produce a gRNA variant; for example a rationally designed variant.

The gRNAs of the disclosure comprise two segments: a targeting sequence and a protein-binding segment. The targeting segment of a gRNA includes a nucleotide sequence (referred to interchangeably as a guide sequence, a spacer, a targeter, or a targeting sequence) that is complementary to (and therefore hybridizes with) a specific sequence (a target site) within the target nucleic acid sequence (e.g., a target ssRNA, a target ssDNA, a strand of a double stranded target DNA, etc.), described more fully below. The targeting sequence of a gRNA is capable of binding to a target nucleic acid sequence, including a coding sequence, a complement of a coding sequence, a non-coding sequence, and to regulatory elements. The protein-binding segment (or "activator" or "protein-binding sequence") interacts with (e.g., binds to) a CasX protein as a complex, forming an RNP (described more fully, below). The protein-binding segment is alternatively referred to herein as a "scaffold", which is comprised of several regions, described more fully, below.

In the case of a dual guide RNA (dgRNA), the targeter and the activator portions each have a duplex-forming segment, where the duplex forming segment of the targeter and the duplex-forming segment of the activator have complementarity with one another and hybridize to one another to form a double stranded duplex (dsRNA duplex for a gRNA). When the gRNA is a gRNA, the term "targeter" or "targeter RNA" is used herein to refer to a crRNA-like molecule (crRNA: "CRISPR RNA") of a CasX dual guide RNA (and therefore of a CasX single guide RNA when the "activator" and the "targeter" are linked together, e.g., by intervening nucleotides). The crRNA has a 5' region that anneals with the tracrRNA followed by the nucleotides of the targeting sequence. Thus, for example, a guide RNA (dgRNA or sgRNA) comprises a guide sequence and a duplex-forming segment of a crRNA, which can also be referred to as a crRNA repeat. A corresponding tracrRNA-like molecule (activator) also comprises a duplex-forming stretch of nucleotides that forms the other half of the dsRNA duplex of the protein-binding segment of the guide RNA. Thus, a targeter and an activator, as a corresponding pair, hybridize to form a dual guide RNA, referred to herein as a "dual-molecule gRNA", a "dgRNA", a "double-molecule guide RNA", or a "two-molecule guide RNA". Site-specific binding and/or cleavage of a target nucleic acid sequence (e.g., genomic DNA) by the CasX protein can occur at one or more locations (e.g., a sequence of a target nucleic acid) determined by base-pairing complementarity between the targeting sequence of the gRNA and the target nucleic acid sequence. Thus, for example, the gRNA of the disclosure have sequences complementarity to and therefore can hybridize with the target nucleic acid that is adjacent to a sequence complementary to a TC PAM motif or a PAM sequence, such as ATC, CTC, GTC, or TTC. Because the targeting sequence of a guide sequence hybridizes with a sequence of a target nucleic acid sequence, a targeter can be modified by a user to hybridize with a specific target nucleic acid sequence, so long as the location of the PAM sequence is considered. Thus, in some cases, the sequence of a targeter may be the complement to a non-naturally occurring sequence. In other cases, the sequence of a targeter may be a naturally-occurring sequence, derived from the complement to the gene sequence to be edited. In other embodiments, the activator and targeter of the gRNA are covalently linked to one another (rather than hybridizing to one another) and comprise a single molecule, referred to herein as a "single-molecule gRNA," "single guide RNA", a "single-molecule guide RNA," a "one-molecule guide RNA", or a "sgRNA". In some embodiments, the sgRNA includes an "activator" or a "targeter" and thus can be an "activator-RNA" and a "targeter-RNA," respectively. In some embodiments, the gRNA is a ribonucleic acid molecule ("gRNA"), and in other embodiments, the gRNA is a chimera, and comprises both DNA and RNA. As used herein, the term gRNA cover naturally-occurring molecules, as well as sequence variants (e.g. non-naturally occurring modified nucleotides).

Collectively, the assembled gRNAs of the disclosure comprise four distinct regions, or domains: the RNA triplex, the scaffold stem, the extended stem, and the targeting sequence that, in the embodiments of the disclosure, is specific for a target nucleic acid and is located on the 3'end of the gRNA. The RNA triplex, the scaffold stem, and the extended stem, together, are referred to as the "scaffold" of the gRNA (gRNA scaffold). The gRNA scaffolds of the disclosure can comprise RNA, or RNA and DNA. The gRNA scaffolds can contains uracils (U), and one or more uracils can be replaced by thymines (T).

b. RNA Triplex

In some embodiments of the guide RNAs provided herein, the gRNA comprises an RNA triplex, which, on some cases, comprises the sequence of a UUU-N$_X$(~4-15)-UUU stem loop (SEQ ID NO: 241) that ends with an AAAG after 2 intervening stem loops (the scaffold stem loop and the extended stem loop), forming a pseudoknot that may also extend past the triplex into a duplex pseudoknot. The UU-UUU-AAA sequence of the triplex forms as a *nexus* between the targeting sequence, scaffold stem, and extended stem. In exemplary gRNAs, the UUU-loop-UUU region is coded for first, then the scaffold stem loop, and then the extended stem loop, which is linked by the tetraloop, and then an AAAG closes off the triplex before becoming the targeting sequence.

c. Scaffold Stem Loop

In some embodiments of gRNAs of the disclosure, the triplex region is followed by the scaffold stem loop. The scaffold stem loop is a region of the gRNA that is bound by CasX protein (such as a reference or CasX variant protein) when an RNP is formed. In some embodiments, the scaffold stem loop is a fairly short and stable stem loop, and increases the overall stability of the gRNA. In some cases, the scaffold stem loop does not tolerate many changes, and requires some form of an RNA bubble. In some embodiments, the scaffold stem is necessary for gRNA function. While it is perhaps analogous to the nexus stem of Cas9 guide as being a critical stem loop, the scaffold stem of a gRNA, in some embodiments, has a necessary bulge (RNA bubble) that is different from many other stem loops found in CRISPR/Cas systems. In some embodiments, the presence of this bulge is conserved across gRNA that interact with different CasX proteins. An exemplary sequence of a scaffold stem loop sequence of a gRNA comprises the sequence CCAGCGACUAUGUCGUAUGG (SEQ ID NO: 242).

d. Extended Stem Loop

In some embodiments of the gRNAs of the disclosure, the scaffold stem loop is followed by the extended stem loop. In some embodiments, the extended stem comprises a synthetic tracr and crRNA fusion that is largely unbound by the CasX protein. In some embodiments, the extended stem loop can be highly malleable. In some embodiments, a single guide gRNA is made with a GAAA tetraloop linker or a GAGAAA linker between the tracr and crRNA in the extended stem loop. In some cases, the targeter and activator of a sgRNA are linked to one another by intervening nucleotides and the linker can have a length of from 3 to 20 nucleotides. In some embodiments of the sgRNAs of the disclosure, the extended stem is a large 32-bp loop that sits outside of the CasX protein in the ribonucleoprotein complex. An exemplary sequence of an extended stem loop sequence of a reference gRNA comprises the sequence (SEQ ID NO: 15)
GCGCUUAUUUAUCGGAGAGAAAUCCGAUAAAUAAGAAGC.

e. Targeting Sequence

In some embodiments of the gRNAs of the disclosure, the extended stem loop is followed by a region that forms part of the triplex, and then the targeting sequence (or "spacer") at the 3' end of the gRNA. The targeting sequence targets the CasX ribonucleoprotein holo complex to a specific region of the target nucleic acid sequence of the gene to be modified. Thus, for example, gRNA targeting sequences of the disclosure have sequences complementarity to, and therefore can hybridize to, a portion of a gene in a target nucleic acid in a eukaryotic cell (e.g., a eukaryotic chromosome, chromosomal sequence, etc.) as a component of the RNP when the TC PAM motif or any one of the PAM sequences TTC, ATC, GTC, or CTC is located 1 nucleotide 5' to the non-target strand sequence complementary to the target sequence. The targeting sequence of a gRNA can be modified so that the gRNA can target a desired sequence of any desired target nucleic acid sequence, so long as the PAM sequence location is taken into consideration. In some embodiments, the gRNA scaffold is 5' of the targeting sequence, with the targeting sequence on the 3' end of the gRNA. In some embodiments, the PAM motif sequence recognized by the nuclease of the RNP is TC. In other embodiments, the PAM sequence recognized by the nuclease of the RNP is NTC; i.e., ATC, CTC, GTC, or TTC.

In some embodiments, the disclosure provides a gRNA wherein the targeting sequence of the gRNA is complementary to a target nucleic acid sequence of a gene to be modified. In some embodiments, the targeting sequence of the gRNA is complementary to a target nucleic acid sequence of a gene comprising one or more mutations compared to a wild-type gene sequence for purposes of editing the sequence comprising the mutations with the CasX:gRNA systems of the disclosure. In such cases, the modification effected by the CasX:gRNA system can either correct or compensate for the mutation or can knock down or knock out expression of the mutant gene product. In other embodiments, the targeting sequence of the gRNA is complementary to a target nucleic acid sequence of a wild-type gene for purposes of editing the sequence to introduce a mutation with the CasX:gRNA systems of the disclosure in order to knock-down or knock-out the gene. In some embodiments, the targeting sequence of a gRNA is designed to be specific for an exon of the gene of the target nucleic acid. In other embodiments, the targeting sequence of a gRNA is designed to be specific for an intron of the gene of the target nucleic acid. In other embodiments, the targeting sequence of the gRNA is designed to be specific for an intron-exon junction of the gene of the target nucleic acid. In other embodiments, the targeting sequence of the gRNA is designed to be specific for a regulatory element of the gene of the target nucleic acid. In some embodiments, the targeting sequence of the gRNA is designed to be complementary to a sequence comprising one or more single nucleotide polymorphisms (SNPs) in a gene of the target nucleic acid. SNPs that are within the coding sequence or within non-coding sequences are both within the scope of the instant disclosure. In other embodiments, the targeting sequence of the gRNA is designed to be complementary to a sequence of an intergenic region of the gene of the target nucleic acid.

In some embodiments, the targeting sequence is specific for a regulatory element that regulates expression of the gene product. Such regulatory elements include, but are not limited to promoter regions, enhancer regions, intergenic regions, 5' untranslated regions (5' UTR), 3' untranslated regions (3' UTR), conserved elements, and regions comprising cis-regulatory elements. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the gene of the target nucleic acid. In the foregoing, the targets are those in which the encoding gene of the target is intended to be knocked out or knocked down such that the gene product is not expressed or is expressed at a lower level in a cell.

In some embodiments, the targeting sequence of a gRNA has between 14 and 35 consecutive nucleotides. In some embodiments, the targeting sequence of a gRNA has between 10 and 30 consecutive nucleotides. In some embodiments, the targeting sequence has 10, 11, 12, 13, 14, 15, 16, 17, 18, 19, 20, 21, 22, 23, 24, 25, 26, 27, 28, 29, or 30 consecutive nucleotides. In some embodiments, the targeting sequence of the gRNA consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 consecutive nucleotides. In some embodiments, the targeting sequence consists of 15 consecutive nucleotides. In some embodiments, the targeting sequence has 10, 11, 12, 13, 14, 15, 16, 17, 18, 19, 20, 21, 22, 23, 24, 25, 26, 27, 28, 29, or 30 consecutive nucleotides and the targeting sequence can comprise 0 to 5, 0 to 4, 0 to 3, or 0 to 2 mismatches relative to the target nucleic acid sequence and retain sufficient binding specificity such that the RNP comprising the gRNA comprising the targeting sequence can form a complementary bond with respect to the target nucleic acid.

In some embodiments, the CasX:gRNA system comprises a first gRNA and further comprises a second (and optionally a third, fourth, fifth, or more) gRNA, wherein the second gRNA or additional gRNA has a targeting sequence complementary to a different or overlapping portion of the target nucleic acid sequence compared to the targeting sequence of the first gRNA such that multiple points in the target nucleic acid are targeted, and for example, multiple breaks are introduced in the target nucleic acid by the CasX. It will be understood that in such cases, the second or additional gRNA is complexed with an additional copy of the CasX protein. By selection of the targeting sequences of the gRNA, defined regions of the target nucleic acid sequence bracketing a mutation can be modified or edited using the CasX:gRNA systems described herein, including facilitating the insertion of a donor template or the excision of the DNA between the cleavage sites in cases, for example, where mutant repeats occur or where removal of an exon comprising mutations nevertheless results in expression of a functional gene product.

f. gRNA Scaffolds

With the exception of the targeting sequence region, the remaining regions of the gRNA are referred to herein as the scaffold. In some embodiments, the gRNA scaffolds are derived from naturally-occurring sequences, described below as reference gRNA. In other embodiments, the gRNA scaffolds are variants of other gRNA variants wherein mutations, insertions, deletions or domain substitutions are introduced to confer desirable properties on the gRNA.

In some embodiments, a reference gRNA comprises a sequence isolated or derived from Deltaproteobacteria. In some embodiments, the sequence is a CasX tracrRNA sequence. Exemplary reference tracrRNA sequences isolated or derived from Deltaproteobacteria may include: ACAUCUGGCGCGUUUAUUCCAUUACUUUGAGCCAGUCCCAGCGACUAUGUCGUAUGGACGAAGCGCUUAUUUAUCGGAGA (SEQ ID NO: 6) and ACAUCUGGCGCGUUUAUUCCAUUACUUUGGAGCCAGUCCCAGCGACUAUGUCGUAUGGACGAAGCGCUUAUUUAUCGG (SEQ ID NO: 7). Exemplary crRNA sequences isolated or derived from Deltaproteobacteria may comprise a sequence of CCGAUAAGUAAAACGCAUCAAAG (SEQ ID NO: 243).

In some embodiments, a reference guide RNA comprises a sequence isolated or derived from Planctomycetes. In some embodiments, the sequence is a tracrRNA sequence. Exemplary reference tracrRNA sequences isolated or derived from Planctomycetes may include: UACUGGCGCUUUUAUCUCAUUACUUUGAGAGCCAUCACCAGCGACUAUGUCGUA UGGGUAAAGCGCUUAUUUAUCGGAGA (SEQ ID NO: 8) and UACUGGCGCUUUUAUCUCAUUACUUUGAGAGCCAUCACCAGCGACUAUGUCGUA UGGGUAAAGCGCUUAUUUAUCGG (SEQ ID NO: 9). Exemplary crRNA sequences isolated or derived from Planctomycetes may comprise a sequence of (SEQ ID NO: 244)
UCUCCGAUAAAUAAGAAGCAUCAAAG.

In some embodiments, a reference gRNA comprises a sequence isolated or derived from Candidatus Sungbacteria. Exemplary CasX reference tracrRNA sequences isolated or derived from Candidatus Sungbacteria may comprise sequences of:

(SEQ ID NO: 10)
GUUUACACACUCCCUCUCAUAGGGU, (SEQ ID NO: 11)
GUUUACACACUCCCUCUCAUGAGGU, (SEQ ID NO: 12)
UUUUACAUACCCCCUCUCAUGGGAU
and (SEQ ID NO: 13)
GUUUACACACUCCCUCUCAUGGGGG.

Table 1 provides the sequences of reference gRNA tracr, cr and scaffold sequences. In some embodiments, the disclosure provides gRNA variant sequences wherein the gRNA has a scaffold comprising a sequence having at least one nucleotide modification relative to a reference gRNA sequence having a sequence of any one of SEQ ID NOS: 4-16 of Table 1. It will be understood that in those embodiments wherein a vector comprises a DNA encoding sequence for a gRNA, or where a gRNA is a chimera of RNA and DNA, that thymine (T) bases can be substituted for the uracil (U) bases of any of the gRNA sequence embodiments described herein.

TABLE 1

Reference gRNA tracr, cr and scaffold sequences

| SEQ ID NO. | Nucleotide Sequence |
|---|---|
| 4 | ACAUCUGGCGCGUUUAUUCCAUUACUUUGGAGCCAGUCCCAGCGACUAUGUCGUAUGGACGAAGCGCUUAUUUAUCGGAGAGAAACCGAUAAGUAAAACGCAUCAAAG |
| 5 | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 6 | ACAUCUGGCGCGUUUAUUCCAUUACUUUGGAGCCAGUCCCAGCGACUAUGUCGUAUGGACGAAGCGCUUAUUUAUCGGAGA |

TABLE 1 -continued

Reference gRNA tracr, cr and scaffold sequences

| SEQ ID NO. | Nucleotide Sequence |
|---|---|
| 7 | ACAUCUGGCGCGUUUAUUCCAUUACUUUGGAGCCAGUCCCAGC GACUAUGUCGUAUGGACGAAGCGCUUAUUUAUCGG |
| 8 | UACUGGCGCUUUUAUCUCAUUACUUUGAGAGCCAUCACCAGCG ACUAUGUCGUAUGGGUAAAGCGCUUAUUUAUCGGAGA |
| 9 | UACUGGCGCUUUUAUCUCAUUACUUUGAGAGCCAUCACCAGCG ACUAUGUCGUAUGGGUAAAGCGCUUAUUUAUCGG |
| 10 | GUUUACACACUCCCUCUCAUAGGGU |
| 11 | GUUUACACACUCCCUCUCAUGAGGU |
| 12 | UUUUACAUACCCCCUCUCAUGGGAU |
| 13 | GUUUACACACUCCCUCUCAUGGGGG |
| 14 | CCAGCGACUAUGUCGUAUGG |
| 15 | GCGCUUAUUUAUCGGAGAGAAAUCCGAUAAAUAAGAAGC |
| 16 | GGCGCUUUUAUCUCAUUACUUUGAGAGCCAUCACCAGCGACUA UGUCGUAUGGGUAAAGCGCUUAUUUAUCGGA | g. gRNA Variants

In another aspect, the disclosure relates to gRNA variants, which comprise one or more modifications relative to a reference gRNA scaffold or are derived from another gRNA variant. As used herein, "scaffold" refers to all parts to the gRNA necessary for gRNA function with the exception of the targeting sequence.

In some embodiments, a gRNA variant comprises one or more nucleotide substitutions, insertions, deletions, or swapped or replaced regions relative to a reference gRNA sequence of the disclosure. In some embodiments, a mutation can occur in any region of a reference gRNA scaffold to produce a gRNA variant. In some embodiments, the scaffold of the gRNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4 or SEQ ID NO: 5. In other embodiments, a gRNA variant comprises one or more nucleotide substitutions, insertions, deletions, or swapped or replaced regions relative to a gRNA variant sequence of the disclosure. In some embodiments, the scaffold of the gRNA variant sequence has at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 2238 or SEQ ID NO: 2239.

In some embodiments, a gRNA variant comprises one or more nucleotide changes within one or more regions of the reference gRNA scaffold that improve a characteristic of the reference gRNA. In other embodiments, a gRNA variant comprises one or more nucleotide changes within one or more regions of the gRNA variant scaffold from which it was derived that improve a characteristic relative to that gRNA. Exemplary regions include the RNA triplex, the pseudoknot, the scaffold stem loop, and the extended stem loop. In some cases, the variant scaffold stem further comprises a bubble. In other cases, the variant scaffold further comprises a triplex loop region. In still other cases, the variant scaffold further comprises a 5' unstructured region. In some embodiments, the gRNA variant scaffold comprises a scaffold stem loop having at least 60% sequence identity, at least 70% sequence identity, at least 80% sequence identity, at least 90% sequence identity, at least 95% sequence identity, or at least 99% sequence identity to SEQ ID NO: 14. In other embodiments, the gRNA variant comprises a scaffold stem loop having the sequence of CCAGCGACUAUGUCGUAGUGG (SEQ ID NO: 245). In other embodiments, the disclosure provides a gRNA scaffold comprising, relative to SEQ ID NO: 5, one or more of a C18G substitution, a G55 insertion, a U1 deletion, and a modified extended stem loop in which the original 6 nt loop and 13 most-loop-proximal base pairs (32 nucleotides total) are replaced by a Uvsx hairpin (4 nt loop and 5 loop-proximal base pairs; 14 nucleotides total) and the loop-distal base of the extended stem is converted to a fully base-paired stem contiguous with the new Uvsx hairpin by deletion of the A99 and substitution of G65U. In the foregoing embodiment, the gRNA scaffold is gRNA variant 174 and comprises the sequence (SEQ ID NO: 2238)
ACUGGCGCUUUUAUCUGAUUACUUUGAGAGCCAUCACCAGCGACUAUGUC

GUAGUGGGUAAAGCUCCCUCUUCGGAGGGAGCAUCAAAG.

All gRNA variants that have one or more improved characteristics, or add one or more new functions when the variant gRNA is compared to a reference gRNA or a gRNA variant that is mutagenized to create a new gRNA variant described herein, are envisaged as within the scope of the disclosure. A representative example of such a gRNA variant is guide 235 (SEQ ID NO: 2292), the design of which is described in the Examples. In some embodiments, the gRNA variant adds a new function to the RNP comprising the gRNA variant. In some embodiments, the gRNA variant has an improved characteristic selected from: increased stability; increased transcription of the gRNA; increased resistance to nuclease activity; increased folding rate of the gRNA; decreased side product formation during folding; increased productive folding; increased binding affinity to a CasX protein; increased binding affinity to a target nucleic acid when complexed with a CasX protein; increased gene editing when complexed with a CasX protein; increased specificity of editing of the target nucleic acid when complexed with a CasX protein; decreased off-target editing when complexed with a CasX protein; and increased ability to utilize a greater spectrum of one or more PAM sequences, including ATC, CTC, GTC, or TTC, in the editing of target nucleic acid when complexed with a CasX protein, and any combination thereof. In some cases, the one or more of the improved characteristics of the gRNA variant is at least about 1.1 to about 100,000-fold increased relative to the reference gRNA of SEQ ID NO: 4 or SEQ ID NO: 5, or to gRNA variant 174 or 175. In other cases, the one or more improved characteristics of the gRNA variant is at least about 1.1, at least about 10, at least about 100, at least about 1000, at least about 10,000, at least about 100,000-fold or more increased relative to the reference gRNA of SEQ ID NO: 4 or SEQ ID NO: 5, or to gRNA variant 174 or 175. In other cases, the one or more of the improved characteristics of the gRNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, increased relative to the reference gRNA of SEQ ID NO: 4 or SEQ ID NO: 5, or to gRNA variant 174 or 175. In other cases, the one or more improved characteristics of the gRNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold increased relative to the reference gRNA of SEQ ID NO: 4 or SEQ ID NO: 5, or to gRNA variant 174 or 175.

In some embodiments, a new gRNA variant can be created by subjecting a reference gRNA or a gRNA variant to a one or more mutagenesis methods, such as the mutagenesis methods described herein, in the Examples below, which may include Deep Mutational Evolution (DME), deep mutational scanning (DMS), error prone PCR, cassette mutagenesis, random mutagenesis, staggered extension PCR, gene shuffling, or domain swapping, in order to generate the gRNA variants of the disclosure. The activity of reference gRNAs or the gRNA variant subject to mutagenesis may be used as a benchmark against which the activity of gRNA variants are compared, thereby measuring improvements in function of gRNA variants. In other embodiments, a reference gRNA or a gRNA may be subjected to one or more deliberate, targeted mutations, substitutions, or domain swaps in order to produce a gRNA variant, for example a rationally designed variant. Exemplary gRNA variants produced by such methods are described in the Examples and representative sequences of gRNA scaffolds are presented in Table 2.

In some embodiments, the gRNA variant comprises one or more modifications compared to a reference gRNA or a gRNA variant scaffold sequence, wherein the one or more modification is selected from: at least one nucleotide substitution in a region of the gRNA; at least one nucleotide deletion in a region of the gRNA; at least one nucleotide insertion in a region of the gRNA; a substitution of all or a portion of a region of the gRNA; a deletion of all or a portion of a region of the gRNA; or any combination of the foregoing. In some cases, the modification is a substitution of 1 to 15 consecutive or non-consecutive nucleotides in one or more regions of the gRNA. In other cases, the modification is a deletion of 1 to 10 consecutive or non-consecutive nucleotides in the gRNA in one or more regions. In other cases, the modification is an insertion of 1 to 10 consecutive or non-consecutive nucleotides in the gRNA in one or more regions. In other cases, the modification is a substitution of the scaffold stem loop or the extended stem loop with an RNA stem loop sequence from a heterologous RNA source with proximal 5' and 3' ends. In some cases, a gRNA variant of the disclosure comprises two or more modifications in one region relative to a reference gRNA or a gRNA variant. In other cases, a gRNA variant of the disclosure comprises modifications in two or more regions. In other cases, a gRNA variant comprises any combination of the foregoing modifications described in this paragraph.

In some embodiments, a 5' G is added to a gRNA variant sequence, relative to the original gRNA, for expression in vivo, as transcription from a U6 promoter is more efficient and more consistent with regard to the start site when the +1 nucleotide is a G. In other embodiments, two 5' Gs are added to generate a gRNA variant sequence for in vitro transcription to increase production efficiency, as T7 polymerase strongly prefers a G in the +1 position and a purine in the +2 position. In some cases, the 5' G bases are added to the reference scaffolds of Table 1. In other cases, the 5' G bases are added to the variant scaffolds of Table 2.

Table 2 provides exemplary gRNA variant scaffold sequences. In some embodiments, the gRNA variant scaffold comprises any one of the sequences SEQ ID NOS: 2101-2332 or 2353-2398 as listed in Table 2, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. In some embodiments, the gRNA variant scaffold comprises any one of the sequences SEQ ID NOS: 2238-2332 or 2353-2398, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. In some embodiments, the gRNA variant scaffold comprises any one of the sequences SEQ ID NOS: 2281-2332 or 2353-2398, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. It will be understood that in those embodiments wherein a vector comprises a DNA encoding sequence for a gRNA, or where a gRNA is a chimera of RNA and DNA, that thymine (T) bases can be substituted for the uracil (U) bases of any of the gRNA sequence embodiments described herein.

TABLE 2

Exemplary gRNA Variant Scaffold Sequences

| SEQ ID NO: | Name | NUCLEOTIDE SEQUENCE OR DESCRIPTION OF MODIFICATION |
|---|---|---|
| 2101 | ND | phage replication stable |
| 2102 | ND | Kissing loop_b1 |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2103 | ND | Kissing loop_a |
| 2104 | ND | 32: uvsX hairpin |
| 2105 | ND | PP7 |
| 2106 | ND | 64: trip mut, extended stem truncation |
| 2107 | ND | hyperstable tetraloop |
| 2108 | ND | C18G |
| 2109 | ND | U17G |
| 2110 | ND | CUUCGG loop |
| 2111 | ND | MS2 |
| 2112 | ND | -1, A2G, -78, G77U |
| 2113 | ND | QB |
| 2114 | ND | 45, 44 hairpin |
| 2115 | ND | U1A |
| 2116 | ND | A14C, U17G |
| 2117 | ND | CUUCGG loop modified |
| 2118 | ND | Kissing loop_b2 |
| 2119 | ND | -76:78, -83:87 |
| 2120 | ND | -4 |
| 2121 | ND | extended stem truncation |
| 2122 | ND | C55 |
| 2123 | ND | trip mut |
| 2124 | ND | -76:78 |
| 2125 | ND | -1:5 |
| 2126 | ND | -83:87 |
| 2127 | ND | =+G28, A82U, -84, |
| 2128 | ND | =+51U |
| 2129 | ND | -1:4, +G5A, +G86, |
| 2130 | ND | =+A94 |
| 2131 | ND | =+G72 |
| 2132 | ND | shorten front, CUUCGG loop modified, extend extended |
| 2133 | ND | A14C |
| 2134 | ND | -1:3,+G3 |
| 2135 | ND | =+C45, +U46 |
| 2136 | ND | CUUCGG loop modified, fun start |
| 2137 | ND | -93:94 |
| 2138 | ND | =+U45 |
| 2139 | ND | -69, -94 |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2140 | ND | -94 |
| 2141 | ND | modified CUUCGG, minus U in 1st triplex |
| 2142 | ND | -1:4, +C4, A14C, U17G, +G72, -76:78, -83:87 |
| 2143 | ND | U1C, -73 |
| 2144 | ND | Scaffold uuCG, stem uuCG. Stem swap, t shorten |
| 2145 | ND | Scaffold uuCG, stem uuCG. Stem swap |
| 2146 | ND | =+G60 |
| 2147 | ND | no stem Scaffold uuCG |
| 2148 | ND | no stem Scaffold uuCG, fun start |
| 2149 | ND | Scaffold uuCG, stem uuCG, fun start |
| 2150 | ND | Pseudoknots |
| 2151 | ND | Scaffold uuCG, stem uuCG |
| 2152 | ND | Scaffold uuCG, stem uuCG, no start |
| 2153 | ND | Scaffold uuCG |
| 2154 | ND | =+GCUC36 |
| 2155 | ND | G quadriplex telomere basket+ends |
| 2156 | ND | G quadriplex M3q |
| 2157 | ND | G quadriplex telomere basket no ends |
| 2158 | ND | 45, 44 hairpin (old version) |
| 2159 | ND | Sarcin-ricin loop |
| 2160 | ND | uvsX, C18G |
| 2161 | ND | truncated stem loop, C18G, trip mut (U10C) |
| 2162 | ND | short phage rep, C18G |
| 2163 | ND | phage rep loop, C18G |
| 2164 | ND | =+G18, stacked onto 64 |
| 2165 | ND | truncated stem loop, C18G, -1 A2G |
| 2166 | ND | phage rep loop, C18G, trip mut (U10C |
| 2167 | ND | short phage rep, C18G, trip mut (U10C |
| 2168 | ND | uvsX, trip mut (U10C |
| 2169 | ND | truncated stem loop |
| 2170 | ND | =+A17, stacked onto 64 |
| 2171 | ND | 3 HDV genomic ribozyme |
| 2172 | ND | phage rep loop, trip mut (U10C) |
| 2173 | ND | -79:80 |
| 2174 | ND | short phage rep, trip mut (U10C |
| 2175 | ND | extra truncated stem loop |
| 2176 | ND | U17G, C18G |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2177 | ND | short phage rep |
| 2178 | ND | uvsX, C18G, -1 A2G |
| 2179 | ND | uvsX, C18G, trip mut (U10C), -1 A2G, HDV -99 G65U |
| 2180 | ND | 3' HDV antigenomic ribozyme |
| 2181 | ND | uvsX, C18G, trip mut (U10C), -1 A2G, HDV AA(98:99)C |
| 2182 | ND | 3' HDV ribozyme (Lior Nissim, Timothy Lu) |
| 2183 | ND | TAC(1:3)GA, stacked onto 64 |
| 2184 | ND | uvsX, -1 A2G |
| 2185 | ND | truncated stem loop, C18G, trip mut (U10C), -1 A2G, HDV -99 G65U |
| 2186 | ND | short phage rep, C18G, trip mut (U10C, -1 A2G, HDV -99 G65U |
| 2187 | ND | 3' sTRSV WT viral Hammerhead ribozyme |
| 2188 | ND | short phage rep, C18G, -1 A2G |
| 2189 | ND | short phage rep, C18G, trip mut (U10C, -1 A2G, 3' genomic HDV |
| 2190 | ND | phage rep loop, C18G, trip mut (U10C, -1 A2G, HDV -99 G65U |
| 2191 | ND | 3' HDV ribozyme (Owen Ryan, Jamie Cate) |
| 2192 | ND | phage rep loop, C18G, -1 A2G |
| 2193 | ND | 0.14 |
| 2194 | ND | -78, G77U |
| 2195 | ND | ND |
| 2196 | ND | short phage rep, -1 A2G |
| 2197 | ND | truncated stem loop, C18G, trip mut (U10C), -1 A2G |
| 2198 | ND | -1, A2G |
| 2199 | ND | truncated stem loop, trip mut (U10C), -1 A2G |
| 2200 | ND | uvsX, C18G, trip mut (U10C), -1 A2G |
| 2201 | ND | phage rep loop, -1 A2G |
| 2202 | ND | phage rep loop, trip mut (U10C), -1 A2G |
| 2203 | ND | phage rep loop, C18G, trip mut (U10C), -1 A2G |
| 2204 | ND | truncated stem loop, C18G |
| 2205 | ND | uvsX, trip mut (U10C), -1 A2G |
| 2206 | ND | truncated stem loop, -1 A2G |
| 2207 | ND | short phage rep, trip mut (U10C), -1 A2G |
| 2208 | ND | 5'HDV ribozyme (Owen Ryan, Jamie Cate) |
| 2209 | ND | 5'HDV genomic ribozyme |
| 2210 | ND | truncated stem loop, C18G, trip mut (U10C), -1 A2G, HDV AA(98:99)C |
| 2211 | ND | 5'env25 pistol ribozyme (with an added CUUCGG loop) |
| 2212 | ND | 5'HDV antigenomic ribozyme |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2213 | ND | 3 Hammerhead ribozyme (Lior Nissim, Timothy Lu) guide scaffold scar |
| 2214 | ND | =+A27, stacked onto 64 |
| 2215 | ND | 5'Hammerhead ribozyme (Lior Nissim, Timothy Lu) smaller scar |
| 2216 | ND | phage rep loop, C18G, trip mut (U10C), -1 A2G, HDV AA(98:99)C |
| 2217 | ND | -27, stacked onto 64 |
| 2218 | ND | 3' Hatchet |
| 2219 | ND | 3' Hammerhead ribozyme (Lior Nissim, Timothy Lu) |
| 2220 | ND | 5' Hatchet |
| 2221 | ND | 5' HDV ribozyme (Lior Nissim, Timothy Lu) |
| 2222 | ND | 5' Hammerhead ribozyme (Lior Nissim, Timothy Lu) |
| 2223 | ND | 3' HH15 Minimal Hammerhead ribozyme |
| 2224 | ND | 5' RBMX recruiting motif |
| 2225 | ND | 3' Hammerhead ribozyme (Lior Nissim, Timothy Lu) smaller scar |
| 2226 | ND | 3' env25 pistol ribozyme (with an added CUUCGG loop) |
| 2227 | ND | 3' Env-9 Twister |
| 2228 | ND | =+AUUAUCUCAUUACU25 |
| 2229 | ND | 5' Env-9 Twister |
| 2230 | ND | 3' Twisted Sister 1 |
| 2231 | ND | no stem |
| 2232 | ND | 5' HH15 Minimal Hammerhead ribozyme |
| 2233 | ND | 5' Hammerhead ribozyme (Lior Nissim, Timothy Lu) guide scaffold scar |
| 2234 | ND | 5' Twisted Sister 1 |
| 2235 | ND | 5' sTRSV WT viral Hammerhead ribozyme |
| 2236 | ND | 148: =+G55, stacked onto 64 |
| 2237 | ND | 158: 103 + 148(+G55) -99, G65U |
| 2238 | 174 | ACUGGCGCUUUUAUCUGAUUACUUUGAGAGCCAUCACCAGCGACUAUGUCGUAG UGGGUAAAGCUCCCUCUUCGGAGGGAGCAUCAAAG |
| 2239 | 175 | ACUGGCGCCCUUAUCUCAUUACUUUGAGAGCCAUCACCAGCGACUAUGUCGUAU GGGUAAAGCGCUUACGGACUUCGGUCCGUAAGAAGCAUCAAAG |
| 2240 | 176 | GCUGGCGCUUUUAUCUGAUUACUUUGAGAGCCAUCACCAGCGACUAUGUCGUAG UGGGUAAAGCUCCCUCUUCGGAGGGAGCAUCAAAG |
| 2241 | 177 | ACUGGCGCUUUUAUCUGAUUACUUUGAGAGCCAUCACCAGCGACUAUGUCGUAU GGGUAAAGCUCCCUCUUCGGAGGGAGCAUCAAAG |
| 2242 | 181 | ACUGGCGCCCUUAUCUGAUUACUUUGAGAGCCAUCACCAGCGACUAUGUCGUAU GGGUAAAGCGCUUACGGACUUCGGUCCGUAAGAAGCAUCAAAG |
| 2243 | 182 | ACUGGCGCUUUUAUCUGAUUACUUUGAGAGCCAUCACCAGCGACUAUGUCGUAU GGGUAAAGCGCUUACGGACUUCGGUCCGUAAGAAGCAUCAAAG |
| 2244 | 183 | ACUGGCGCUUUUAUCUGAUUACUUUGAGAGCCAUCACCAGCGACUAUGUCGUAG UGGGUAAAGCGCUUACGGACUUCGGUCCGUAAGAAGCAUCAAAG |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2245 | 184 | ACUGGCGCUUUUAUCUGAUUACUUUGAGAGCCAUCACCAGCGACUAUGUCGUAU UGGGUAAAGCUCCCUCUUCGGAGGGAGCAUCAAAG |
| 2246 | 185 | ACUGGCGCUUUUAUCUGAUUACUUUGAGAGCCAUCACCAGCGACUAUGUCGUAU UGGGUAAAGCGCUUACGGACUUCGGUCCGUAAGAAGCAUCAAAG |
| 2247 | 186 | ACUGGCGCCUUUAUCAUCAUUACUUUGAGAGCCAUCACCAGCGACUAUGUCGUA UGGGUAAAGCGCUUACGGACUUCGGUCCGUAAGAAGCAUCAAAG |
| 2248 | 187 | ACUGGCGCUUUUAUCUGAUUACUUUGAGAGCCAUCACCAGCGACUAUGUCGUAG UGGGUAAAGCGCCCUCUUCGGAGGGAAGCAUCAAAG |
| 2249 | 188 | ACUGGCGCUUUUAUCUGAUUACUUUGAGAGCCAUCACCAGCGACUAUGUCGUAG UGGGUAAAGCUCACAUGAGGAUCACCCAUGUGAGCAUCAAAG |
| 2250 | 189 | ACUGGCACUUUUACCUGAUUACUUUGAGAGCCAACACCAGCGACUAUGUCGUAG UGGGUAAAGCUCCCUCUUCGGAGGGAGCAUCAAAG |
| 2251 | 190 | ACUGGCACUUUUAUCUGAUUACUUUGAGAGCCAUCACCAGCGACUAUGUCGUAG UGGGUAAAGCUCCCUCUUCGGAGGGAGCAUCAAAG |
| 2252 | 191 | ACUGGCCCUUUUAUCUGAUUACUUUGAGAGCCAUCACCAGCGACUAUGUCGUAG UGGGUAAAGCUCCCUCUUCGGAGGGAGCAUCAAAG |
| 2253 | 192 | ACUGGCGCUUUUACCUGAUUACUUUGAGAGCCAUCACCAGCGACUAUGUCGUAG UGGGUAAAGCUCCCUCUUCGGAGGGAGCAUCAAAG |
| 2254 | 193 | ACUGGCGCUUUUAUCUGAUUACUUUGAGAGCCAACACCAGCGACUAUGUCGUAG UGGGUAAAGCUCCCUCUUCGGAGGGAGCAUCAAAG |
| 2255 | 195 | ACUGGCACCUUUACCUGAUUACUUUGAGAGCCAACACCAGCGACUAUGUCGUAU GGGUAAAGCGCUUACGGACUUCGGUCCGUAAGAAGCAUCAAAG |
| 2256 | 196 | ACUGGCACCUUUAUCUGAUUACUUUGAGAGCCAUCACCAGCGACUAUGUCGUAU GGGUAAAGCGCUUACGGACUUCGGUCCGUAAGAAGCAUCAAAG |
| 2257 | 197 | ACUGGCCCCUUUAUCUGAUUACUUUGAGAGCCAUCACCAGCGACUAUGUCGUAU GGGUAAAGCGCUUACGGACUUCGGUCCGUAAGAAGCAUCAAAG |
| 2258 | 198 | ACUGGCGCCUUUAUCUGAUUACUUUGAGAGCCAACACCAGCGACUAUGUCGUAU GGGUAAAGCGCUUACGGACUUCGGUCCGUAAGAAGCAUCAAAG |
| 2259 | 199 | GCUGGCGCUUUUAUCUGAUUACUUUGAGAGCCAUCACCAGCGACUAUGUCGUAG UGGGUAAAGCUCCCUCUUCGGAGGGAGCAUCAAAG |
| 2260 | 200 | GACUGGCGCUUUUAUCUGAUUACUUUGAGAGCCAUCACCAGCGACUAUGUCGUA GUGGGUAAAGCUCCCUCUUCGGAGGGAGCAUCAAAG |
| 2261 | 201 | ACUGGCGCCUUUAUCUGAUUACUUUGGAGAGCCAUCACCAGCGACUAUGUCGUA GUGGGUAAAGCUCCCUCUUCGGAGGGAGCAUCAAAG |
| 2262 | 202 | ACUGGCGCAUUUAUCUGAUUACUUUGUGAGCCAUCACCAGCGACUAUGUCGUAG UGGGUAAAGCUCCCUCUUCGGAGGGAGCAUCAAAG |
| 2263 | 203 | ACUGGCGCCUUUAUCUGAUUACUUUGAGAGCCAUCACCAGCGACUAUGUCGUAG UGGGUAAAGCUCCCUCUUCGGAGGGAGCAUCAAAG |
| 2264 | 204 | ACUGGCGCUUUUAUCUGAUUACUUUGGAGAGCCAUCACCAGCGACUAUGUCGUA GUGGGUAAAGCUCCCUCUUCGGAGGGAGCAUCAAAG |
| 2265 | 205 | ACUGGCGCAUUUAUCUGAUUACUUUGAGAGCCAUCACCAGCGACUAUGUCGUAG UGGGUAAAGCUCCCUCUUCGGAGGGAGCAUCAAAG |
| 2266 | 206 | ACUGGCGCUUUUAUCUGAUUACUUUGUGAGCCAUCACCAGCGACUAUGUCGUAG UGGGUAAAGCUCCCUCUUCGGAGGGAGCAUCAAAG |
| 2267 | 207 | ACUGGCGCUUUUAUUCUGAUUACUUUGAGAGCCAUCACCAGCGACUAUGUCGUA GUGGGUAAAGCUCCCUCUUCGGAGGGAGCAUCAAAG |
| 2268 | 208 | ACGGCGCUUUUAUCUGAUUACUUUGAGAGCCAUCACCAGCGACUAUGUCGUAGU GGGUAAAGCUCCCUCUUCGGAGGGAGCAUCAAAG |
| 2269 | 209 | ACUGGCGCUUUUAUAUGAUUACUUUGAGAGCCAUCACCAGCGACUAUGUCGUAG UGGGUAAAGCUCCCUCUUCGGAGGGAGCAUCAAAG |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2270 | 210 | ACUGGCGCUUUUAUCUUGAUUACUUUGAGAGCCAUCACCAGCGACUAUGUCGUA GUGGGUAAAGCUCCCUCUUCGGAGGGAGCAUCAAAG |
| 2271 | 211 | ACUGGCGCUUUUAUCUGAUUACUUUGAGAGCCAGCACCAGCGACUAUGUCGUAG UGGGUAAAGCUCCCUCUUCGGAGGGAGCAUCAAAG |
| 2272 | 212 | ACUGGCGCUGUUAUCUGAUUACUUCGAGAGCCAUCACCAGCGACUAUGUCGUAG UGGGUAAAGCUCCCUCUUCGGAGGGAGCAUCGAAG |
| 2273 | 213 | ACUGGCGCUCUUAUCUGAUUACUUCGAGAGCCAUCACCAGCGACUAUGUCGUAG UGGGUAAAGCUCCCUCUUCGGAGGGAGCAUCGAAG |
| 2274 | 214 | ACUGGCGCUUGUAUCUGAUUACUCUGAGAGCCAUCACCAGCGACUAUGUCGUAG UGGGUAAAGCUCCCUCUUCGGAGGGAGCAUCAGAG |
| 2275 | 215 | ACUGGCGCUUCUAUCUGAUUACUCUGAGAGCCAUCACCAGCGACUAUGUCGUAG UGGGUAAAGCUCCCUCUUCGGAGGGAGCAUCAGAG |
| 2276 | 216 | ACUGGCGCUUUGAUCUGAUUACCUUGAGAGCCAUCACCAGCGACUAUGUCGUAG UGGGUAAAGCUCCCUCUUCGGAGGGAGCAUCAAGG |
| 2277 | 217 | ACUGGCGCUUUCAUCUGAUUACCUUGAGAGCCAUCACCAGCGACUAUGUCGUAG UGGGUAAAGCUCCCUCUUCGGAGGGAGCAUCAAGG |
| 2278 | 218 | ACUGGCGCUGUUAUCUGAUUACUUUGAGAGCCAUCACCAGCGACUAUGUCGUAG UGGGUAAAGCUCCCUCUUCGGAGGGAGCAUCAAAG |
| 2279 | 219 | ACUGGCGCUUUUAUCUGAUUACUUUGAGAGCCAUCACCAGCGACUAUGUCGUAG UGGGUAAAGCUCCCUCUUCGGAGGGAGCAUCGAAG |
| 2280 | 220 | ACUGGCGCUUUUAUCUGAUUACUUCGAGAGCCAUCACCAGCGACUAUGUCGUAG UGGGUAAAGCUCCCUCUUCGGAGGGAGCAUCAAAG |
| 2281 | 221 | ACUGGCACUUCUAUCUGAUUACUCUGAGAGCCAUCACCAGCGACUAUGUCGUAU GGGUAAAGCCGCUUACGGACUUCGGUCCGUAAGAGGCAUCAGAG |
| 2282 | 222 | ACUGGCACUUCUAUCUGAUUACUCUGAGAGCCAUCACCAGCGACUAUGUCGUAG UGGGUAAAGCUCCCUCUUCGGAGGGAGCAUCAGAG |
| 2283 | 223 | ACUGGCACCUUUAUCUGAUUACUUUGAGAGCCAUCACCAGCGACUAUGUCGUAU GGGUAAAGCCGCUUACGGACUUCGGUCCGUAAGAGGCAUCAAAG |
| 2284 | 224 | ACUGGCACUUGUAUCUGAUUACUCUGAGAGCCAUCACCAGCGACUAUGUCGUAU GGGUAAAGCCGCUUACGGACUUCGGUCCGUAAGAGGCAUCAGAG |
| 2285 | 225 | ACUGGCACUUGUAUCUGAUUACUCUGAGAGCCAUCACCAGCGACUAUGUCGUAG UGGGUAAAGCUCCCUCUUCGGAGGGAGCAUCAGAG |
| 2332 | 226 | ACUGGCGCUUUUAUCUGAUUACUUUGAGAGCCAUCACCAGCGACUAUGUCGUAG UGGGUAAAGCUGCACUAUGGGCGCAGCGUCAAUGACGCUGACGGUACAGGCCAG ACAAUUAUUGUCUGGUAUAGUGCAGCAUCAAAG |
| 2286 | 229 | ACUGGCACUUUUAUCUGAUUACUUUGAGAGCCAUCACCAGCGACUAUGUCGUAU GGGUAAAGCGCUUACGGACUUCGGUCCGUAAGAAGCAUCAAAG |
| 2287 | 230 | ACUGGCACUUCUAUCUGAUUACUCUGAGAGCCAUCACCAGCGACUAUGUCGUAU GGGUAAAGCGCUUACGGACUUCGGUCCGUAAGAAGCAUCAGAG |
| 2288 | 231 | ACUGGCGCUUCUAUCUGAUUACUCUGAGAGCCAUCACCAGCGACUAUGUCGUAU GGGUAAAGCCGCUUACGGACUUCGGUCCGUAAGAGGCAUCAGAG |
| 2289 | 232 | ACUGGCACUUCUAUCUGAUUACUCUGAGCGCCAUCACCAGCGACUAUGUCGUAU GGGUAAAGCCGCUUACGGACUUCGGUCCGUAAGAGGCAUCAGAG |
| 2290 | 233 | ACUGGCGCUUCUAUCUGAUUACUCUGAGCGCCAUCACCAGCGACUAUGUCGUAU GGGUAAAGCCGCUUACGGACUUCGGUCCGUAAGAGGCAUCAGAG |
| 2291 | 234 | ACUGGCGCUUCUAUCUGAUUACUCUGAGCGCCAUCACCAGCGACUAUGUCGUAU GGGUAAAGCGCCUUACGGACUUCGGUCCGUAAGGAGCAUCAGAG |
| 2292 | 235 | ACUGGCGCUUCUAUCUGAUUACUCUGAGCGCCAUCACCAGCGACUAUGUCGUAG UGGGUAAAGCCGCUUACGGACUUCGGUCCGUAAGAGGCAUCAGAG |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2293 | 236 | ACGGGACUUUCUAUCUGAUUACUCUGAAGUCCCUCACCAGCGACUAUGUCGUAU<br>GGGUAAAGCCGCUUACGGACUUCGGUCCGUAAGAGGCAUCAGAG |
| 2294 | 237 | ACCUGUAGUUCUAUCUGAUUACUCUGACUACAGUCACCAGCGACUAUGUCGUAU<br>GGGUAAAGCCGCUUACGGACUUCGGUCCGUAAGAGGCAUCAGAG |
| 2295 | 238 | ACUGGCGCUUUUAUCUGAUUACUUUGAGAGCCAUCACCAGCGACUAUGUCGUAG<br>UGGGUAAAGCUGCACGGUGGGCGCAGCUUCGGCUGACGGUACACCGUGCAGCAU<br>CAAAG |
| 2296 | 239 | ACUGGCGCUUUUAUCUGAUUACUUUGAGAGCCAUCACCAGCGACUAUGUCGUAG<br>UGGGUAAAGCUGCACGGUGGGCGCAGCUUCGGCUGACGGUACACCGGUGGGCGC<br>AGCUUCGGCUGACGGUACACCGUGCAGCAUCAAAG |
| 2297 | 240 | ACUGGCGCUUUUAUCUGAUUACUUUGAGAGCCAUCACCAGCGACUAUGUCGUAG<br>UGGGUAAAGCUGCACGGUGGGCGCAGCUUCGGCUGACGGUACACCGGUGGGCGC<br>AGCUUCGGCUGACGGUACACCGGUGGGCGCAGCUUCGGCUGACGGUACACCGUG<br>CAGCAUCAAAG |
| 2298 | 241 | ACUGGCGCUUUUAUCUGAUUACUUUGAGAGCCAUCACCAGCGACUAUGUCGUAG<br>UGGGUAAAGCUGCACGGUGGGCGCAGCUUCGGCUGACGGUACACCGGUGGGCGC<br>AGCUUCGGCUGACGGUACACCGGUGGGCGCAGCUUCGGCUGACGGUACACCGGU<br>GGGCGCAGCUUCGGCUGACGGUACACCGUGCAGCAUCAAAG |
| 2299 | 242 | ACUGGCGCUUUUAUCUGAUUACUUUGAGAGCCAUCACCAGCGACUAUGUCGUAG<br>UGGGUAAAGCUGCACGGUGGGCGCAGCUUCGGCUGACGGUACACCGGUGGGCGC<br>AGCUUCGGCUGACGGUACACCGGUGGGCGCAGCUUCGGCUGACGGUACACCGGU<br>GGGCGCAGCUUCGGCUGACGGUACACCGGUGGGCGCAGCUUCGGCUGACGGUAC<br>ACCGUGCAGCAUCAAAG |
| 2300 | 243 | ACUGGCGCUUUUAUCUGAUUACUUUGAGAGCCAUCACCAGCGACUAUGUCGUAG<br>UGGGUAAAGCUGCACCUAGCGGAGGCUAGGUGCAGCAUCAAAG |
| 2301 | 244 | ACUGGCGCUUUUAUCUGAUUACUUUGAGAGCCAUCACCAGCGACUAUGUCGUAG<br>UGGGUAAAGCUGCACCUCGGCUUGCUGAAGCGCGCACGGCAAGAGGCGAGGUGC<br>AGCAUCAAAG |
| 2302 | 245 | ACUGGCGCUUUUAUCUGAUUACUUUGAGAGCCAUCACCAGCGACUAUGUCGUAG<br>UGGGUAAAGCUGCACCUCUCUCGACGCAGGACUCGGCUUGCUGAAGCGCGCACG<br>GCAAGAGGCGAGGGGCGGCGACUGGUGAGUACGCCAAAAAUUUUGACUAGCGGA<br>GGCUAGAAGGAGAGAGGUGCAGCAUCAAAG |
| 2303 | 246 | ACUGGCGCUUUUAUCUGAUUACUUUGAGAGCCAUCACCAGCGACUAUGUCGUAG<br>UGGGUAAAGCUGCACGGUGCCCGUCUGUUGUGUCGAGAGACGCCAAAAAUUUUG<br>ACUAGCGGAGGCUAGAAGGAGAGAGAUGGGUGCCGUGCAGCAUCAAAG |
| 2304 | 247 | ACUGGCGCUUUUAUCUGAUUACUUUGAGAGCCAUCACCAGCGACUAUGUCGUAG<br>UGGGUAAAGCUGCACAUGGAGAGGAGAUGUGCAGCAUCAAAG |
| 2305 | 248 | ACUGGCGCUUUUAUCUGAUUACUUUGAGAGCCAUCACCAGCGACUAUGUCGUAG<br>UGGGUAAAGCUGCACAUGGAGAUGUGCAGCAUCAAAG |
| 2306 | 249 | ACUGGCGCUUUUAUCUGAUUACUUUGAGAGCCAUCACCAGCGACUAUGUCGUAG<br>UGGGUAAAGCUUGGGCGCAGCGUCAAUGACGCUGACGGUACAAGCAUCAAAG |
| 2307 | 250 | ACUGGCGCUUUUAUCUGAUUACUUUGAGAGCCAUCACCAGCGACUAUGUCGUAG<br>UGGGUAAAGCUGCACUAUGGGCGCAGCGUCAAUGACGCUGACGGUACAGGCCAC<br>AUGAGGAUCACCCAUGUGGUAUAGUGCAGCAUCAAAG |
| 2308 | 251 | ACUGGCGCUUUUAUCUGAUUACUUUGAGAGCCAUCACCAGCGACUAUGUCGUAG<br>UGGGUAAAGCUGCACUAUGGGCGCAGCUCAUGAGGAUCACCCAUGAGCUGACGG<br>UACAGGCCACAUGAGGAUCACCCAUGUGGUAUAGUGCAGCAUCAAAG |
| 2309 | 252 | ACUGGCGCUUUUAUCUGAUUACUUUGAGAGCCAUCACCAGCGACUAUGUCGUAG<br>UGGGUAAAGCUGCACUAUGGGCGCAGCGUCAAUGACGCUGACGGUACAGGCCAC<br>AUGGCAGUCGUAACGACGCGGGUGGUAUAGUGCAGCAUCAAAG |
| 2310 | 253 | ACUGGCGCUUUUAUCUGAUUACUUUGAGAGCCAUCACCAGCGACUAUGUCGUAG<br>UGGGUAAAGCUGCACUAUGGGCGCAGCAAACAUGGCAGUCCUAAGGACGCGGGU<br>UUUGCUGACGGUACAGGCCACAUGGCAGUCGUAACGACGCGGGUGGUAUAGUGC<br>AGCAUCAAAG |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2311 | 254 | ACUGGCGCUUUUAUCUGAUUACUUUGAGAGCCAUCACCAGCGACUAUGUCGUAG UGGGUAAAGCUGCACUAUGGGCGCAGACAUGGCAGUCGUAACGACGCGGGUCUG ACGGUACAGGCCACAUGAGGAUCACCCAUGUGGUAUAGUGCAGCAUCAAAG |
| 2312 | 255 | ACUGGCGCUUUUAUCUGAUUACUUUGAGAGCCAUCACCAGCGACUAUGUCGUAG UGGGUAAAGCUGCACUAAGGAGUUUAUAUGGAAACCCUUAGUGCAGCAUCAAAG |
| 2313 | 256 | ACUGGCGCUUUUAUCUGAUUACUUUGAGAGCCAUCACCAGCGACUAUGUCGUAG UGGGUAAAGCUCAGGAAGCACUAUGGGCGCAGCGUCAAUGACGCUGACGGUACA GGCCAGACAAUUAUUGUCUGGUAUAGUGCAGCAGCAGAACAAUUUGCUGAGGGC UAUUGAGGCGCAACAGCAUCUGUUGCAACUCACAGUCUGGGGCAUCAAGCAGCU CCAGGCAAGAAUCCUGAGCAUCAAAG |
| 2314 | 257 | ACUGGCGCUUUUAUCUGAUUACUUUGAGAGCCAUCACCAGCGACUAUGUCGUAG UGGGUAAAGCUGCACGCCCUGAAGAAGGGCGUGCAGCAUCAAAG |
| 2315 | 258 | ACUGGCGCUUUUAUCUGAUUACUUUGAGAGCCAUCACCAGCGACUAUGUCGUAG UGGGUAAAGCUGCACGGCUCGUGUAGCUCAUUAGCUCCGAGCCGUGCAGCAUCA AAG |
| 2316 | 259 | ACUGGCGCUUUUAUCUGAUUACUUUGAGAGCCAUCACCAGCGACUAUGUCGUAG UGGGUAAAGCUGCACCCGUGUGCAUCCGCAGUGUCGGAUCCACGGGUGCAGCAU CAAAG |
| 2317 | 260 | ACUGGCGCUUUUAUCUGAUUACUUUGAGAGCCAUCACCAGCGACUAUGUCGUAG UGGGUAAAGCUGCACGGAAUCCAUUGCACUCCGGAUUUCACUAGGUGCAGCAUC AAAG |
| 2318 | 261 | ACUGGCGCUUUUAUCUGAUUACUUUGAGAGCCAUCACCAGCGACUAUGUCGUAG UGGGUAAAGCUGCACAUGCAUGUCUAAGACAGCAUGUGCAGCAUCAAAG |
| 2319 | 262 | ACUGGCGCUUUUAUCUGAUUACUUUGAGAGCCAUCACCAGCGACUAUGUCGUAG UGGGUAAAGCUGCACAAAACAUAAGGAAAACCUAUGUUGUGCAGCAUCAAAG |
| 2320 | 263 | ACUGGCGCUUCUAUCUGAUUACUCUGAGCGCCAUCACCAGCGACUAUGUCGUAG UGGGUAAAGCCGCUUACGGACUAUGGGCGCAGCGUCAAUGACGCUGACGGUACA GGCCAGACAAUUAUUGUCUGGUAUAGUCCGUAAGAGGCAUCAGAG |
| 2321 | 264 | ACUGGCGCUUCUAUCUGAUUACUCUGAGCGCCAUCACCAGCGACUAUGUCGUAG UGGGUAAAGCCGCUUACGGGUGGGCGCAGCGUCAAUGACGCUGACGGUACAGGC CAGACAAUUAUUGUCUGGUACCCGUAAGAGGCAUCAGAG |
| 2322 | 265 | ACUGGCGCUUCUAUCUGAUUACUCUGAGCGCCAUCACCAGCGACUAUGUCGUAG UGGGUAAAGCCGCUUACGGUAUGGGCGCAGCGUCAAUGACGCUGACGGUACAGG CCACAUGAGGAUCACCCAUGUGGUAUACCGUAAGAGGCAUCAGAG |
| 2323 | 266 | ACUGGCGCUUUUAUCUGAUUACUUUGAGAGCCAUCACCAGCGACUAUGUCGUAG UGGGUAAAGCUCCCUAUGGGCGCAGCGUCAAUGACGCUGACGGUACAGGCCACA UGAGGAUCACCCAUGUGGUAUAGGGAGCAUCAAAG |
| 2324 | 267 | ACUGGCGCUUCUAUCUGAUUACUCUGAGCGCCAUCACCAGCGACUAUGUCGUAG UGGGUAAAGCCGCUUACGGUAUGGGCGCAGCUCAUGAGGAUCACCCAUGAGCUG ACGGUACAGGCCACAUGAGGAUCACCCAUGUGGUAUACCGUAAGAGGCAUCAGA G |
| 2325 | 268 | ACUGGCGCUUUUAUCUGAUUACUUUGAGAGCCAUCACCAGCGACUAUGUCGUAG UGGGUAAAGCUCCCUAUGGGCGCAGCUCAUGAGGAUCACCCAUGAGCUGACGGU ACAGGCCACAUGAGGAUCACCCAUGUGGUACJAGGGAGCAUCAAAG |
| 2326 | 269 | ACUGGCGCUUCUAUCUGAUUACUCUGAGCGCCAUCACCAGCGACUAUGUCGUAG UGGGUAAAGCCGCUUACGGUAUGGGCGCAGCGUCAAUGACGCUGACGGUACAGG CCACAUGGCAGUCGUAACGACGCGGGUGGUAUACCGUAAGAGGCAUCAGAG |
| 2327 | 270 | ACUGGCGCUUUUAUCUGAUUACUUUGAGAGCCAUCACCAGCGACUAUGUCGUAG UGGGUAAAGCUCCCUAUGGGCGCAGCGUCAAUGACGCUGACGGUACAGGCCACA UGGCAGUCGUAACGACGCGGGUGGUAUAGGGAGCAUCAAAG |
| 2328 | 271 | ACUGGCGCUUCUAUCUGAUUACUCUGAGCGCCAUCACCAGCGACUAUGUCGUAG UGGGUAAAGCCGCUUACGGUAUGGGCGCAGCAAACAUGGCAGUCCUAAGGACGC GGGUUUUGCUGACGGUACAGGCCACAUGGCAGUCGUAACGACGCGGGUGGUAUA CCGUAAGAGGCAUCAGAG |
| 2329 | 272 | ACUGGCGCUUUUAUCUGAUUACUUUGAGAGCCAUCACCAGCGACUAUGUCGUAG UGGGUAAAGCUCCCUAUGGGCGCAGCAAACAUGGCAGUCCUAAGGACGCGGGUU |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| | | UUGCUGACGGUACAGGCCACAUGGCAGUCGUAACGACGCGGGUGGUAUAGGGAG CAUCAAAG |
| 2330 | 273 | ACUGGCGCUUCUAUCUGAUUACUCUGAGCGCCAUCACCAGCGACUAUGUCGUAG UGGGUAAAGCCGCUUACGGUAUGGGCGCAGACAUGGCAGUCGUAACGACGCGGG UCUGACGGUACAGGCCACAUGAGGAUCACCCAUGUGGUAUACCGUAAGAGGCAU CAGAG |
| 2331 | 274 | ACUGGCGCUUUUAUCUGAUUACUUUGAGAGCCAUCACCAGCGACUAUGUCGUAG UGGGUAAAGCUCCCUAUGGGCGCAGACAUGGCAGUCGUAACGACGCGGGUCUGA CGGUACAGGCCACAUGAGGAUCACCCAUGUGGUAUAGGGAGCAUCAAAG |
| 2353 | 275 | ACUGGCGCUUUUAUCUGAUUACUUUGAGAGCCAUCACCAGCGACUAUGU CGUAGUGGGUAAAGCUGCACUAUGGGCGCAGCACCUGAGGAUCACCCAG GUGCUGACGGUACAGGCCACCUGAGGAUCACCCAGGUGGUAUAGUGCAG CAUCAAAG |
| 2354 | 276 | ACUGGCGCUUUUAUCUGAUUACUUUGAGAGCCAUCACCAGCGACUAUGU CGUAGUGGGUAAAGCUGCACUAUGGGCGCAGCGCAUGAGGAUCACCCAU GCGCUGACGGUACAGGCCGCAUGAGGAUCACCCAUGCGGUAUAGUGCAG CAUCAAAG |
| 2355 | 277 | ACUGGCGCUUUUAUCUGAUUACUUUGAGAGCCAUCACCAGCGACUAUGU CGUAGUGGGUAAAGCUGCACUAUGGGCGCAGCGCCUGAGGAUCACCCAG GCGCUGACGGUACAGGCCGCCUGAGGAUCACCCAGGCGGUAUAGUGCAG CAUCAAAG |
| 2356 | 278 | ACUGGCGCUUUUAUCUGAUUACUUUGAGAGCCAUCACCAGCGACUAUGU CGUAGUGGGUAAAGCUGCACUAUGGGCGCAGCGCCUGAGCAUCAGCCAG GCGCUGACGGUACAGGCCGCCUGAGCAUCAGCCAGGCGGUAUAGUGCAG CAUCAAAG |
| 2357 | 279 | ACUGGCGCUUUUAUCUGAUUACUUUGAGAGCCAUCACCAGCGACUAUGU CGUAGUGGGUAAAGCUGCACUAUGGGCGCAGCACAUGAGCAUCAGCCAU GUGCUGACGGUACAGGCCACAUGAGCAUCAGCCAUGUGGUAUAGUGCAG CAUCAAAG |
| 2358 | 280 | ACUGGCGCUUUUAUCUGAUUACUUUGAGAGCCAUCACCAGCGACUAUGU CGUAGUGGGUAAAGCUGCACUAUGGGCGCAGCACAUGAGUAUCAACCAU GUGCUGACGGUACAGGCCACAUGAGUAUCAACCAUGUGGUAUAGUGCAG CAUCAAAG |
| 2359 | 281 | ACUGGCGCUUUUAUCUGAUUACUUUGAGAGCCAUCACCAGCGACUAUGU CGUAGUGGGUAAAGCUGCACUAUGGGCGCAGCACAUGAGAAUCAGCCAU GUGCUGACGGUACAGGCCACAUGAGAAUCAGCCAUGUGGUAUAGUGCAG CAUCAAAG |
| 2360 | 282 | ACUGGCGCUUUUAUCUGAUUACUUUGAGAGCCAUCACCAGCGACUAUGU CGUAGUGGGUAAAGCUGCACUAUGGGCGCAGCCCUUGAGGAUCACCCAU GUGCUGACGGUACAGGCCCCUUGAGGAUCACCCAUGUGGUAUAGUGCAG CAUCAAAG |
| 2361 | 283 | ACUGGCGCUUUUAUCUGAUUACUUUGAGAGCCAUCACCAGCGACUAUGU CGUAGUGGGUAAAGCUGCACUAUGGGCGCAGCACUUGAGGAUCACCCAU GUGCUGACGGUACAGGCCACUUGAGGAUCACCCAUGUGGUAUAGUGCAG CAUCAAAG |
| 2362 | 284 | ACUGGCGCUUUUAUCUGAUUACUUUGAGAGCCAUCACCAGCGACUAUGU CGUAGUGGGUAAAGCUGCACUAUGGGCGCAGCACCUGAGGAUCACCCAU GUGCUGACGGUACAGGCCACCUGAGGAUCACCCAUGUGGUAUAGUGCAG CAUCAAAG |
| 2363 | 285 | ACUGGCGCUUUUAUCUGAUUACUUUGAGAGCCAUCACCAGCGACUAUGUCGUAG UGGGUAAAGCUGCACUAUGGGCGCAGCACAUGAGGAUCACCUAUGUGCUGACGG UACAGGCCACAUGAGGAUCACCUAUGUGGUAUAGUGCAGCAUCAAAG |
| 2364 | 286 | ACUGGCGCUUUUAUCUGAUUACUUUGAGAGCCAUCACCAGCGACUAUGUCGUAG UGGGUAAAGCUGCACUAUGGGCGCAGCACAUUAGGAUCACCAAUGUGCUGACGG UACAGGCCACAUUAGGAUCACCAAUGUGGUAUAGUGCAGCAUCAAAG |
| 2365 | 287 | ACUGGCGCUUUUAUCUGAUUACUUUGAGAGCCAUCACCAGCGACUAUGUCGUAG UGGGUAAAGCUGCACUAUGGGCGCAGCACAUUAGGAUCACCGAUGUGCUGACGG UACAGGCCACAUUAGGAUCACCGAUGUGGUAUAGUGCAGCAUCAAAG |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2366 | 288 | ACUGGCGCUUUUAUCUGAUUACUUUGAGAGCCAUCACCAGCGACUAUGUCGUAG UGGGUAAAGCUGCACUAUGGGCGCAGCACAUUAGGAUCACCUAUGUGCUGACGG UACAGGCCACAUUAGGAUCACCUAUGUGGUAUAGUGCAGCAUCAAAG |
| 2367 | 289 | ACUGGCGCUUUUAUCUGAUUACUUUGAGAGCCAUCACCAGCGACUAUGUCGUAG UGGGUAAAGCUGCACUAUGGGCGCAGCACAUGAGGAUUACCCAUGUGCUGACGG UACAGGCCACAUGAGGAUUACCCAUGUGGUAUAGUGCAGCAUCAAAG |
| 2368 | 290 | ACUGGCGCUUUUAUCUGAUUACUUUGAGAGCCAUCACCAGCGACUAUGUCGUAG UGGGUAAAGCUGCACUAUGGGCGCAGCACAUGAGGAUAACCCAUGUGCUGACGG UACAGGCCACAUGAGGAUAACCCAUGUGGUAUAGUGCAGCAUCAAAG |
| 2369 | 291 | ACUGGCGCUUUUAUCUGAUUACUUUGAGAGCCAUCACCAGCGACUAUGUCGUAG UGGGUAAAGCUGCACUAUGGGCGCAGCACAUGAGGAUGACCCAUGUGCUGACGG UACAGGCCACAUGAGGAUGACCCAUGUGGUAUAGUGCAGCAUCAAAG |
| 2370 | 292 | ACUGGCGCUUUUAUCUGAUUACUUUGAGAGCCAUCACCAGCGACUAUGUCGUAG UGGGUAAAGCUGCACUAUGGGCGCAGCACAUGAGGACCACCCAUGUGCUGACGG UACAGGCCACAUGAGGACCACCCAUGUGGUAUAGUGCAGCAUCAAAG |
| 2371 | 293 | ACUGGCGCUUUUAUCUGAUUACUUUGAGAGCCAUCACCAGCGACUAUGUCGUAG UGGGUAAAGCUGCACUAUGGGCGCAGCAGAUGAGGAUCACCCAUGGGCUGACGG UACAGGCCAGAUGAGGAUCACCCAUGGGGUAUAGUGCAGCAUCAAAG |
| 2372 | 294 | ACUGGCGCUUUUAUCUGAUUACUUUGAGAGCCAUCACCAGCGACUAUGUCGUAG UGGGUAAAGCUGCACUAUGGGCGCAGCACAUGGGGAUCACCCAUGUGCUGACGG UACAGGCCACAUGGGGAUCACCCAUGUGGUAUAGUGCAGCAUCAAAG |
| 2373 | 295 | ACUGGCGCUUUUAUCUGAUUACUUUGAGAGCCAUCACCAGCGACUAUGUCGUAG UGGGUAAAGCUGCACUAUGGGCGCAGCACAUGAGGAUCACCCAUGUGCUGACGG UACAGGCCACAUGAGGAUCACCCAUGUGGUAUAGUGCAGCAUCAAAG |
| 2374 | 296 | ACUGGCGCUUUUAUCUGAUUACUUUGAGAGCCAUCACCAGCGACUAUGUCGUAG UGGGUAAAGCUCACCUGAGGAUCACCCAGGUGAGCAUCAAAG |
| 2375 | 297 | ACUGGCGCUUUUAUCUGAUUACUUUGAGAGCCAUCACCAGCGACUAUGUCGUAG UGGGUAAAGCUCGCAUGAGGAUCACCCAUGCGAGCAUCAAAG |
| 2376 | 298 | ACUGGCGCUUUUAUCUGAUUACUUUGAGAGCCAUCACCAGCGACUAUGUCGUAG UGGGUAAAGCUCGCCUGAGGAUCACCCAGGCGAGCAUCAAAG |
| 2377 | 299 | ACUGGCGCUUUUAUCUGAUUACUUUGAGAGCCAUCACCAGCGACUAUGUCGUAG UGGGUAAAGCUCGCCUGAGCAUCAGCCAGGCGAGCAUCAAAG |
| 2378 | 300 | ACUGGCGCUUUUAUCUGAUUACUUUGAGAGCCAUCACCAGCGACUAUGUCGUAG UGGGUAAAGCUCACAUGAGCAUCAGCCAUGUGAGCAUCAAAG |
| 2379 | 301 | ACUGGCGCUUUUAUCUGAUUACUUUGAGAGCCAUCACCAGCGACUAUGUCGUAG UGGGUAAAGCUCACAUGAGUAUCAACCAUGUGAGCAUCAAAG |
| 2380 | 302 | ACUGGCGCUUUUAUCUGAUUACUUUGAGAGCCAUCACCAGCGACUAUGUCGUAG UGGGUAAAGCUCACAUGAGAAUCAGCCAUGUGAGCAUCAAAG |
| 2381 | 303 | ACUGGCGCUUUUAUCUGAUUACUUUGAGAGCCAUCACCAGCGACUAUGUCGUAG UGGGUAAAGCUCCCUUGAGGAUCACCCAUGUGAGCAUCAAAG |
| 2382 | 304 | ACUGGCGCUUUUAUCUGAUUACUUUGAGAGCCAUCACCAGCGACUAUGUCGUAG UGGGUAAAGCUCACUUGAGGAUCACCCAUGUGAGCAUCAAAG |
| 2383 | 305 | ACUGGCGCUUUUAUCUGAUUACUUUGAGAGCCAUCACCAGCGACUAUGUCGUAG UGGGUAAAGCUCACCUGAGGAUCACCCAUGUGAGCAUCAAAG |
| 2384 | 306 | ACUGGCGCUUUUAUCUGAUUACUUUGAGAGCCAUCACCAGCGACUAUGUCGUAG UGGGUAAAGCUCACAUGAGGAUCACCUAUGUGAGCAUCAAAG |
| 2385 | 307 | ACUGGCGCUUUUAUCUGAUUACUUUGAGAGCCAUCACCAGCGACUAUGUCGUAG UGGGUAAAGCUCACAUUAGGAUCACCAAUGUGAGCAUCAAAG |
| 2386 | 308 | ACUGGCGCUUUUAUCUGAUUACUUUGAGAGCCAUCACCAGCGACUAUGUCGUAG UGGGUAAAGCUCACAUUAGGAUCACCGAUGUGAGCAUCAAAG |
| 2387 | 309 | ACUGGCGCUUUUAUCUGAUUACUUUGAGAGCCAUCACCAGCGACUAUGUCGUAG UGGGUAAAGCUCACAUUAGGAUCACCUAUGUGAGCAUCAAAG |

TABLE 2-continued

Exemplary gRNA Variant Scaffold Sequences

| SEQ ID NO: | Name | NUCLEOTIDE SEQUENCE OR DESCRIPTION OF MODIFICATION |
|---|---|---|
| 2388 | 310 | ACUGGCGCUUUUAUCUGAUUACUUUGAGAGCCAUCACCAGCGACUAUGUCGUAG UGGGUAAAGCUCACAUGAGGAUUACCCAUGUGAGCAUCAAAG |
| 2389 | 311 | ACUGGCGCUUUUAUCUGAUUACUUUGAGAGCCAUCACCAGCGACUAUGUCGUAG UGGGUAAAGCUCACAUGAGGAUAACCCAUGUGAGCAUCAAAG |
| 2390 | 312 | ACUGGCGCUUUUAUCUGAUUACUUUGAGAGCCAUCACCAGCGACUAUGUCGUAG UGGGUAAAGCUCACAUGAGGAUGACCCAUGUGAGCAUCAAAG |
| 2391 | 313 | ACUGGCGCUUUUAUCUGAUUACUUUGAGAGCCAUCACCAGCGACUAUGUCGUAG UGGGUAAAGCUCACAUGAGGACCACCCAUGUGAGCAUCAAAG |
| 2392 | 314 | ACUGGCGCUUUUAUCUGAUUACUUUGAGAGCCAUCACCAGCGACUAUGUCGUAG UGGGUAAAGCUCAGAUGAGGAUCACCCAUGGGAGCAUCAAAG |
| 2393 | 315 | ACUGGCGCUUUUAUCUGAUUACUUUGAGAGCCAUCACCAGCGACUAUGUCGUAG UGGGUAAAGCUCACAUGGGGAUCACCCAUGUGAGCAUCAAAG |
| 2394 | 317 | ACUGGCGCUUCUAUCUGAUUACUCUGAGCGCCAUCACCAGCGACUAUGUCGUAG UGGGUAAAGCUCACAUGAGGAUCACCCAUGUGAGCAUCAGAG |
| 2395 | 318 | ACUGGCGCUUCUAUCUGAUUACUCUGAGCGCCAUCACCAGCGACUAUGUCGUAG UGGGUAAAGCUGCACUAUGGGCGCAGCGUCAAUGACGCUGACGGUACAGGCCAC AUGAGGAUCACCCAUGUGGUAUAGUGCAGCAUCAGAG |
| 2396 | 319 | ACUGGCGCUUCUAUCUGAUUACUCUGAGCGCCAUCACCAGCGACUAUGUCGUAG UGGGUAAAGCUGCACUAUGGGCGCAGCUCAUGAGGAUCACCCAUGAGCUGACGG UACAGGCCACAUGAGGAUCACCCAUGUGGUAUAGUGCAGCAUCAGAG |
| 2397 | 320 | ACUGGCGCUUCUAUCUGAUUACUCUGAGCGCCAUCACCAGCGACUAUGUCGUAG UGGGUAAAGCUGCACUAUGGGCGCAGACAUGGCAGUCGUAACGACGCGGGUCUG ACGGUACAGGCCACAUGAGGAUCACCCAUGUGGUAUAGUGCAGCAUCAGAG |
| 2398 | 321 | ACUGGCGCUUUUAUCUGAUUACUUUGAGAGCCAUCACCAGCGACUAUGUCGUAG UGGGUAAAGCUGCACUAUGGGGCCACAUGAGGAUCACCCAUGUGGUGUACAGCG CAGCGUCAAUGACGCUGACGAUAGUGCAGCAUCAAAG |

In some embodiments, a sgRNA variant comprises one or more additional modifications to a sequence of SEQ ID NO:2238, SEQ ID NO:2239, SEQ ID NO:2240, SEQ ID NO:2241, SEQ ID NO:2243, SEQ ID NO:2256, SEQ ID NO:2274, SEQ ID NO:2275, SEQ ID NO:2279, SEQ ID NO:2281, SEQ ID NO: 2285, SEQ ID NO: 2289, SEQ ID NO: 2292, or SEQ ID NO: 2308 of Table 2.

In some embodiments of the gRNA variants of the disclosure, the gRNA variant comprises at least one modification compared to the reference guide scaffold of SEQ ID NO:5, wherein the at least one modification is selected from one or more of: (a) a C18G substitution in the triplex loop; (b) a G55 insertion in the stem bubble; (c) a U1 deletion; (d) a modification of the extended stem loop wherein (i) a 6 nt loop and 13 loop-proximal base pairs are replaced by a Uvsx hairpin; and (ii) a deletion of A99 and a substitution of G65U that results in a loop-distal base that is fully base-paired.

In some embodiments, a gRNA variant comprises an exogenous stem loop having a long non-coding RNA (lncRNA). As used herein, a lncRNA refers to a non-coding RNA that is longer than approximately 200 bp in length. In some embodiments, the 5' and 3' ends of the exogenous stem loop are base paired; i.e., interact to form a region of duplex RNA. In some embodiments, the 5' and 3' ends of the exogenous stem loop are base paired, and one or more regions between the 5' and 3' ends of the exogenous stem loop are not base paired, forming the loop.

In some embodiments, the disclosure provide gRNA variants with nucleotide modifications relative to reference gRNA having: (a) substitution of 1 to 15 consecutive or non-consecutive nucleotides in the gRNA variant in one or more regions; (b) a deletion of 1 to 10 consecutive or non-consecutive nucleotides in the gRNA variant in one or more regions; (c) an insertion of 1 to 10 consecutive or non-consecutive nucleotides in the gRNA variant in one or more regions; (d) a substitution of the scaffold stem loop or the extended stem loop with an RNA stem loop sequence from a heterologous RNA source with proximal 5' and 3' ends; or any combination of (a)-(d). Any of the substitutions, insertions and deletions described herein can be combined to generate a gRNA variant of the disclosure. For example, a gRNA variant can comprise at least one substitution and at least one deletion relative to a reference gRNA, at least one substitution and at least one insertion relative to a reference gRNA, at least one insertion and at least one deletion relative to a reference gRNA, or at least one substitution, one insertion and one deletion relative to a reference gRNA.

In some embodiments, a sgRNA variant of the disclosure comprises one or more modifications to the sequence of a previously generated variant, the previously generated variant itself serving as the sequence to be modified. In some cases, one or modifications are introduced to the pseudoknot region of the scaffold. In other cases, one or modifications are introduced to the triplex region of the scaffold. In other cases, one or modifications are introduced to the scaffold bubble. In other cases, one or modifications are introduced to the extended stem region of the scaffold. In still other cases, one of modifications are introduced into two or more of the foregoing regions. Such modifications can comprise an insertion, deletion, or substitution of one or more nucleotides in the foregoing regions, or any combination thereof. Exemplary methods to generate and assess the modifications are described in Example 15.

In some embodiments, a sgRNA variant comprises one or more modifications to a sequence of SEQ ID NO: 2238, SEQ ID NO: 2239, SEQ ID NO: 2240, SEQ ID NO: 2241, SEQ ID NO:2241, SEQ ID NO:2274, SEQ ID NO:2275, SEQ ID NO: 2279, or SEQ ID NO: 2285, SEQ ID NO: 2289, SEQ ID NO: 2292, or SEQ ID NO: 2308.

In exemplary embodiments, a gRNA variant comprises one or more modifications relative to gRNA scaffold variant 174 (SEQ ID NO:2238), wherein the resulting gRNA variant exhibits a improved functional characteristic compared to the parent 174, when assessed in an in vitro or in vivo assay under comparable conditions. In other exemplary embodiments, a gRNA variant comprises one or more modifications relative to gRNA scaffold variant 175 (SEQ ID NO:2239), wherein the resulting gRNA variant exhibits a improved functional characteristic compared to the parent 175, when assessed in an in vitro or in vivo assay under comparable conditions. For example, variants with modifications to the triplex loop of gRNA variant 175 show high enrichment relative to the 175 scaffold, particularly mutations to C15 or C17. Additionally, changes to either member of the predicted pair in the pseudoknot stem between G7 and A29 are both highly enriched relative to the 175 scaffold, with converting A29 to a C or a T to form a canonical Watson-Crick pairing (G7:C29), and the second of which would form a GU wobble pair (G7:U29), both of which may be expected to increase stability of the helix relative to the G:A pair. In addition, the insertion of a C at position 54 in guide scaffold 175 results in an enriched modification.

In some embodiments, the disclosure provides gRNA variants comprising one or more modifications to the gRNA scaffold variant 174 (SEQ ID NO: 2238) selected from the group consisting of the modifications of Table 19, wherein the resulting gRNA variant exhibits an improved functional characteristic compared to the parent 174, when assessed in an in vitro or in vivo assay under comparable conditions. In some embodiments, the improved functional characteristic is one or more functional properties selected from the group consisting of increased editing activity, increased pseudoknot stem stability, increased triplex region stability, increased scaffold stem stability, extended stem stability, reduced off-target folding intermediates, and increased binding affinity to a Class 2, Type V CRISPR protein. In the foregoing embodiments, the gRNA comprising one or more modifications to the gRNA scaffold variant 174 selected from the group consisting of the modifications of Table 16 (with a linked targeting sequence and complexed with a Class 2, Type V CRISPR protein) exhibits an improved enrichment score ($\log_2$) of at least about 2.0, at least about 2.5, at least about 3, or at least about 3.5 greater compared to the score of the gRNA scaffold of SEQ ID NO: 2238 in an in vitro assay.

In some embodiments, the disclosure provides gRNA variants comprising one or more modifications to the gRNA scaffold variant 175 (SEQ ID NO: 2239) selected from the group consisting of the modifications of Table 20, wherein the resulting gRNA variant exhibits an improved functional characteristic compared to the parent 175, when assessed in an in vitro or in vivo assay under comparable conditions. In some embodiments, the improved functional characteristic is one or more functional properties selected from the group consisting of increased editing activity, increased pseudoknot stem stability, increased triplex region stability, increased scaffold stem stability, extended stem stability, reduced off-target folding intermediates, and increased binding affinity to a Class 2, Type V CRISPR protein. In the foregoing embodiments, the gRNA comprising one or more modifications to the gRNA scaffold variant 175 selected from the group consisting of the modifications of Table 16 (with a linked targeting sequence and complexed with a Class 2, Type V CRISPR protein) exhibits an improved enrichment score ($\log_2$) of at least about 1.2, at least about 1.5, at least about 2.0, at least about 2.5, at least about 3, or at least about 3.5 greater compared to the score of the gRNA scaffold of SEQ ID NO: 2239 in an in vitro assay.

In a particular embodiment, the one or more modifications of gRNA scaffold variant 174 are selected from the group consisting of nucleotide positions U11, U24, A29, U65, C66, C68, A69, U76, G77, A79, and A87. In a particular embodiment, the modifications of gRNA scaffold variant 174 are U11C, U24C, A29C, U65C, C66G, C68U, an insertion of ACGGA at position 69, an insertion of UCCGU at position 76, G77A, an insertion of GA at position 79, A87G. In another particular embodiment, the modifications of gRNA scaffold variant 175 are selected from the group consisting of nucleotide positions C9, U11, C17, U24, A29, G54, C65, A89, and A96. In a particular embodiment, the modifications of gRNA scaffold variant 174 are C9U, U11C, C17G, U24C, A29C, an insertion of G at position 54, an insertion of C at position 65, A89G, and A96G.

In exemplary embodiments, a gRNA variant comprises one or more modifications relative to gRNA scaffold variant 215 (SEQ ID NO:2275), wherein the resulting gRNA variant exhibits an improved functional characteristic compared to the parent 215, when assessed in an in vitro or in vivo assay under comparable conditions.

In exemplary embodiments, a gRNA variant comprises one or more modifications relative to gRNA scaffold variant 221 (SEQ ID NO: 2281), wherein the resulting gRNA variant exhibits an improved functional characteristic compared to the parent 221, when assessed in an in vitro or in vivo assay under comparable conditions.

In exemplary embodiments, a gRNA variant comprises one or more modifications relative to gRNA scaffold variant 225 (SEQ ID NO: 2285), wherein the resulting gRNA variant exhibits an improved functional characteristic compared to the parent 225, when assessed in an in vitro or in vivo assay under comparable conditions.

In exemplary embodiments, a gRNA variant comprises one or more modifications relative to gRNA scaffold variant 235 (SEQ ID NO: 2292), wherein the resulting gRNA variant exhibits an improved functional characteristic compared to the parent 225, when assessed in an in vitro or in vivo assay under comparable conditions.

In exemplary embodiments, a gRNA variant comprises one or more modifications relative to gRNA scaffold variant 251 (SEQ ID NO: 2308), wherein the resulting gRNA variant exhibits an improved functional characteristic compared to the parent 251, when assessed in an in vitro or in vivo assay under comparable conditions.

In the foregoing embodiments, the improved functional characteristic includes, but is not limited to one or more of increased stability, increased transcription of the gRNA, increased resistance to nuclease activity, increased folding rate of the gRNA, decreased side product formation during folding, increased productive folding, increased binding affinity to a CasX protein, increased binding affinity to a target nucleic acid when complexed with the CasX protein, increased gene editing when complexed with the CasX protein, increased specificity of editing when complexed with the CasX protein, decreased off-target editing when complexed with the CasX protein, and increased ability to utilize a greater spectrum of one or more PAM sequences, including ATC, CTC, GTC, or TTC, in the modifying of target nucleic acid when complexed with the CasX protein. In some cases, the one or more of the improved characteristics of the gRNA variant is at least about 1.1 to about 100,000-fold improved relative to the gRNA from which it was derived. In other cases, the one or more improved characteristics of the gRNA variant is at least about 1.1, at least about 10, at least about 100, at least about 1000, at least about 10,000, at least about 100,000-fold or more improved relative to the gRNA from which it was derived. In other cases, the one or more of the improved characteristics of the gRNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the gRNA from which it was derived. In other cases, the one or more improved characteristics of the gRNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to the gRNA from which it was derived.

In some embodiments, the gRNA variant comprises an exogenous extended stem loop, with such differences from a reference gRNA described as follows. In some embodiments, an exogenous extended stem loop has little or no identity to the reference stem loop regions disclosed herein (e.g., SEQ ID NO:15). In some embodiments, an exogenous stem loop is at least 10 bp, at least 20 bp, at least 30 bp, at least 40 bp, at least 50 bp, at least 60 bp, at least 70 bp, at least 80 bp, at least 90 bp, at least 100 bp, at least 200 bp, at least 300 bp, at least 400 bp, at least 500 bp, at least 600 bp, at least 700 bp, at least 800 bp, at least 900 bp, at least 1,000 bp, at least 2,000 bp, at least 3,000 bp, at least 4,000 bp, at least 5,000 bp, at least 6,000 bp, at least 7,000 bp, at least 8,000 bp, at least 9,000 bp, at least 10,000 bp, at least 12,000 bp, at least 15,000 bp or at least 20,000 bp. In some embodiments, the gRNA variant comprises an extended stem loop region comprising at least 10, at least 100, at least 500, at least 1000, or at least 10,000 nucleotides. In some embodiments, the heterologous stem loop increases the stability of the gRNA. In some embodiments, the heterologous RNA stem loop is capable of binding a protein, an RNA structure, a DNA sequence, or a small molecule. In some embodiments, an exogenous stem loop region replacing the stem loop comprises an RNA stem loop or hairpin in which the resulting gRNA has increased stability and, depending on the choice of loop, can interact with certain cellular proteins or RNA. Such exogenous extended stem loops can comprise, for example a thermostable RNA such as MS2 hairpin (ACAUGAGGAUCACCCAUGU (SEQ ID NO: 1137)), Qβ hairpin (UGCAUGUCUAAGACAGCA (SEQ ID NO: 32)), U1 hairpin II (AAUCCAUUGCACUCCG-GAUU (SEQ ID NO: 33)), Uvsx (CCUCUUCGGAGG (SEQ ID NO: 34)), PP7 hairpin (AGGAGUUUCUAUG-GAAACCCU (SEQ ID NO: 35)), Phage replication loop (AGGUGGGACGACCUCUCGGUCGUCCUAUCU (SEQ ID NO: 36)), Kissing loop_a (UGCUCG-CUCCGUUCGAGCA (SEQ ID NO: 37)), Kissing loop_b1 (UGCUCGACGCGUCCUCGAGCA (SEQ ID NO: 38)), Kissing loop_b2 (UGCUCGUUUGCGGCUACGAGCA (SEQ ID NO: 39)), G quadriplex M3q (AGGGAGGGAGG-GAGAGG (SEQ ID NO: 40)), G quadriplex telomere basket (GGUUAGGGUUAGGGUUAGG (SEQ ID NO: 41)), Sarcin-ricin loop (CUGCUCAGUACGAGAGGAACCGCAG (SEQ ID NO: 42)) or Pseudoknots (UACACUGG-GAUCGCUGAAUUAGAGAUCGGCGUCCUUU-CAUUCUAUAUACUUUGG AGUUUUAAAAUGUCU-CUAAGUACA (SEQ ID NO: 43)). In some embodiments, one of the foregoing hairpin sequences is incorporated into the stem loop to help traffic the incorporation of the gRNA (and an associated CasX in an RNP complex) into a budding XDP (described more fully, below) when the counterpart ligand is incorporated into the Gag polyprotein of the XDP.

In some embodiments, a gRNA variant comprises a terminal fusion partner. The term gRNA variant is inclusive of variants that include exogenous sequences such as terminal fusions, or internal insertions. Exemplary terminal fusions may include fusion of the gRNA to a self-cleaving ribozyme or protein binding motif. As used herein, a "ribozyme" refers to an RNA or segment thereof with one or more catalytic activities similar to a protein enzyme. Exemplary ribozyme catalytic activities may include, for example, cleavage and/or ligation of RNA, cleavage and/or ligation of DNA, or peptide bond formation. In some embodiments, such fusions could either improve scaffold folding or recruit DNA repair machinery. For example, a gRNA may in some embodiments be fused to a hepatitis delta virus (HDV) antigenomic ribozyme, HDV genomic ribozyme, hatchet ribozyme (from metagenomic data), env25 pistol ribozyme (representative from Aliistipes putredinis), HH15 Minimal Hammerhead ribozyme, tobacco ringspot virus (TRSV) ribozyme, WT viral Hammerhead ribozyme (and rational variants), or Twisted Sister 1 or RBMX recruiting motif. Hammerhead ribozymes are RNA motifs that catalyze reversible cleavage and ligation reactions at a specific site within an RNA molecule. Hammerhead ribozymes include type I, type II and type III hammerhead ribozymes. The HDV, pistol, and hatchet ribozymes have self-cleaving activities. gRNA variants comprising one or more ribozymes may allow for expanded gRNA function as compared to a gRNA reference. For example, gRNAs comprising self-cleaving ribozymes can, in some embodiments, be transcribed and processed into mature gRNAs as part of polycistronic transcripts. Such fusions may occur at either the 5' or the 3' end of the gRNA. In some embodiments, a gRNA variant comprises a fusion at both the 5' and the 3' end, wherein each fusion is independently as described herein.

In the embodiments of the gRNA variants, the gRNA variant further comprises a spacer (or targeting sequence) region located at the 3' end of the gRNA, capable of hybridizing with a target nucleic acid which comprises at least 14 to about 35 nucleotides wherein the spacer is designed with a sequence that is complementary to a target nucleic acid. In some embodiments, the encoded gRNA variant comprises a targeting sequence of at least 10 to 20 nucleotides complementary to a target nucleic acid. In some embodiments, the targeting sequence has 14, 15, 16, 17, 18, 19, 20, 21, 22, 23, 24, 25, 26, 27, 28, 29, or 30 nucleotides. In some embodiments, the encoded gRNA variant comprises a targeting sequence having 20 nucleotides. In some embodiments, the targeting sequence has 25 nucleotides. In some embodiments, the targeting sequence has 24 nucleotides. In some embodiments, the targeting sequence has 23 nucleotides. In some embodiments, the targeting sequence has 22 nucleotides. In some embodiments, the targeting sequence has 21 nucleotides. In some embodiments, the targeting sequence has 20 nucleotides. In some embodiments, the targeting sequence has 19 nucleotides. In some embodiments, the targeting sequence has 18 nucleotides. In some embodiments, the targeting sequence has 17 nucleotides. In some embodiments, the targeting sequence has 16 nucleotides. In some embodiments, the targeting sequence has 15 nucleotides. In some embodiments, the targeting sequence has 14 nucleotides.

h. Complex Formation with Class 2, Type V Protein

In some embodiments, upon expression, the gRNA variant is complexed as an RNP with a Class 2, Type V protein, including CasX variant proteins comprising any one of the sequences SEQ ID NOS: 247-592 or 1147-1231 of Table 3, or a sequence having at least about 50%, at least about 60%, at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% identity thereto. In some embodiments, upon expression, the gRNA variant is complexed as an RNP with a CasX variant protein comprising any one of the sequences SEQ ID NOS: 270-592 or 1147-1231, or a sequence having at least about 50%, at least about 60%, at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% identity thereto. In some embodiments, upon expression, the gRNA variant is complexed as an RNP with a CasX variant protein comprising any one of the sequences SEQ ID NOS: 415-592 or 1147-1231, or a sequence having at least about 50%, at least about 60%, at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% identity thereto.

In some embodiments, a gRNA variant has an improved ability to form a complex with a CasX variant protein when compared to a reference gRNA, thereby improving its ability to form a cleavage-competent ribonucleoprotein (RNP) complex with the CasX protein, as described in the Examples. Improving ribonucleoprotein complex formation may, in some embodiments, improve the efficiency with which functional RNPs are assembled. In some embodiments, greater than 90%, greater than 93%, greater than 95%, greater than 96%, greater than 97%, greater than 98% or greater than 99% of RNPs comprising a gRNA variant and its targeting sequence are competent for gene editing of a target nucleic acid.

Exemplary nucleotide changes that can improve the ability of gRNA variants to form a complex with CasX protein may, in some embodiments, include replacing the scaffold stem with a thermostable stem loop. Without wishing to be bound by any theory, replacing the scaffold stem with a thermostable stem loop could increase the overall binding stability of the gRNA variant with the CasX protein. Alternatively, or in addition, removing a large section of the stem loop could change the gRNA variant folding kinetics and make a functional folded gRNA easier and quicker to structurally-assemble, for example by lessening the degree to which the gRNA variant can get "tangled" in itself. In some embodiments, choice of scaffold stem loop sequence can be varied with different targeting sequences that are utilized for the gRNA. In some embodiments, scaffold sequence can be tailored to the targeting sequence and therefore the target sequence. Biochemical assays can be used to evaluate the binding affinity of CasX protein for the gRNA variant to form the RNP, including the assays of the Examples. For example, a person of ordinary skill can measure changes in the amount of a fluorescently tagged gRNA that is bound to an immobilized CasX protein, as a response to increasing concentrations of an additional unlabeled "cold competitor" gRNA. Alternatively, or in addition, fluorescence signal can be monitored to or see how it changes as different amounts of fluorescently labeled gRNA are flowed over immobilized CasX protein. Alternatively, the ability to form an RNP can be assessed using in vitro cleavage assays against a defined target nucleic acid sequence, as described in the Examples.

i. Chemically Modified gRNAs

In some embodiments, the disclosure provides chemically-modified gRNAs. In some embodiments, the present disclosure provides a chemically-modified gRNA that has guide NA functionality and has reduced susceptibility to cleavage by a nuclease. A gRNA that comprises any nucleotide other than the four canonical ribonucleotides A, C, G, and U, or a deoxynucleotide, is a chemically modified gRNA. In some cases, a chemically-modified gRNA comprises any backbone or internucleotide linkage other than a natural phosphodiester internucleotide linkage. In certain embodiments, the retained functionality includes the ability of the modified gRNA to bind to a CasX of any of the embodiments described herein. In certain embodiments, the retained functionality includes the ability of the modified gRNA to bind to a target nucleic acid sequence. In certain embodiments, the retained functionality includes targeting a CasX protein or the ability of a pre-complexed RNP to bind to a target nucleic acid sequence. In certain embodiments, the retained functionality includes the ability to nick a target polynucleotide by a CasX-gRNA. In certain embodiments, the retained functionality includes the ability to cleave a target nucleic acid sequence by a CasX-gRNA. In certain embodiments, the retained functionality is any other known function of a gRNA in a recombinant system with a CasX chimera protein of the embodiments of the disclosure.

In some embodiments, the disclosure provides a chemically-modified gRNA in which a nucleotide sugar modification is incorporated into the gRNA selected from the group consisting of 2'-O—$C_{1-4}$alkyl such as 2'-O-methyl (2'-OMe), 2'-deoxy (2'-H), 2'-O—$C_{1-3}$alkyl-O—$C_{1-3}$alkyl such as 2'-methoxyethyl ("2'-MOE"), 2'-fluoro ("2'-F"), 2'-amino ("2'-$NH_2$"), 2'-arabinosyl ("2'-arabin") nucleotide, 2'-F-arabinosyl ("2'-F-arabino") nucleotide, 2'-locked nucleic acid ("LNA") nucleotide, 2'-unlocked nucleic acid ("ULNA") nucleotide, a sugar in L form ("L-sugar"), and 4'-thioribosyl nucleotide. In other embodiments, an internucleotide linkage modification incorporated into the guide RNA is selected from the group consisting of: phosphorothioate "P(S)" (P(S)), phosphonocarboxylate (P(CH$_2$)$_n$COOR) such as phosphonoacetate "PACE" (P(CH$_2$COO$^-$)), thiophosphonocarboxylate ((S)P (CH$_2$)$_n$COOR) such as thiophosphonoacetate "thioPACE" ((S)P(CH$_2$)$_n$COO$^-$)), alkylphosphonate (P(C$_{1-3}$alkyl) such as methylphosphonate —P(CH$_3$), boranophosphonate (P(BH$_3$)), and phosphorodithioate (P(S)$_2$).

In certain embodiments, the disclosure provides a chemically-modified gRNA in which a nucleobase ("base") modification is incorporated into the gRNA selected from the group consisting of: 2-thiouracil ("2-thioU"), 2-thiocytosine ("2-thioC"), 4-thiouracil ("4-thioU"), 6-thioguanine ("6-thioG"), 2-aminoadenine ("2-aminoA"), 2-aminopurine, pseudouracil, hypoxanthine, 7-deazaguanine, 7-deaza-8-azaguanine, 7-deazaadenine, 7-deaza-8-azaadenine, 5-methylcytosine ("5-methylC"), 5-methyluracil ("5-methylU"), 5-hydroxymethylcytosine, 5-hydroxymethyluracil, 5,6-dehydrouracil, 5-propynylcytosine, 5-propynyluracil, 5-ethynylcytosine, 5-ethynyluracil, 5-allyluracil ("5-allylU"), 5-allylcytosine ("5-allylC"), 5-aminoallyluracil ("5-aminoallylU"), 5-aminoallyl-cytosine ("5-aminoallylC"), an abasic nucleotide, Z base, P base, Unstructured Nucleic Acid ("UNA"), isoguanine ("isoG"), isocytosine ("isoC"), 5-methyl-2-pyrimidine, x(A,G,C,T) and y(A,G,C,T).

In other embodiments, the disclosure provides a chemically-modified gRNA in which one or more isotopic modifications are introduced on the nucleotide sugar, the nucleobase, the phosphodiester linkage and/or the nucleotide phosphates, including nucleotides comprising one or more $^{15}$N, $^{13}$C, $^{14}$C, deuterium, $^3$H, $^{32}$P, $^{125}$I, $^{131}$I atoms or other atoms or elements used as tracers.

In some embodiments, an "end" modification incorporated into the gRNA is selected from the group consisting of: PEG (polyethyleneglycol), hydrocarbon linkers (including: heteroatom (O,S,N)-substituted hydrocarbon spacers; halo-substituted hydrocarbon spacers; keto-, carboxyl-, amido-, thionyl-, carbamoyl-, thionocarbamaoyl-containing hydrocarbon spacers), spermine linkers, dyes including fluorescent dyes (for example fluoresceins, rhodamines, cyanines) attached to linkers such as, for example 6-fluorescein-hexyl, quenchers (for example dabcyl, BHQ) and other labels (for example biotin, digoxigenin, acridine, streptavidin, avidin, peptides and/or proteins). In some embodiments, an "end" modification comprises a conjugation (or ligation) of the gRNA to another molecule comprising an oligonucleotide of deoxynucleotides and/or ribonucleotides, a peptide, a protein, a sugar, an oligosaccharide, a steroid, a lipid, a folic acid, a vitamin and/or other molecule. In certain embodiments, the disclosure provides a chemically-modified gRNA in which an "end" modification (described above) is located internally in the gRNA sequence via a linker such as, for example, a 2-(4-butylamidofluorescein)propane-1,3-diol bis (phosphodiester) linker, which is incorporated as a phosphodiester linkage and can be incorporated anywhere between two nucleotides in the gRNA.

In some embodiments, the disclosure provides a chemically-modified gRNA having an end modification comprising a terminal functional group such as an amine, a thiol (or sulfhydryl), a hydroxyl, a carboxyl, carbonyl, thionyl, thiocarbonyl, a carbamoyl, a thiocarbamoyl, a phoshoryl, an alkene, an alkyne, an halogen or a functional group-terminated linker that can be subsequently conjugated to a desired moiety selected from the group consisting of a fluorescent dye, a non-fluorescent label, a tag (for $^{14}$C, example biotin, avidin, streptavidin, or moiety containing an isotopic label such as $^{15}$N, $^{13}$C, deuterium, $^3$H, $^{32}$P, $^{125}$I and the like), an oligonucleotide (comprising deoxynucleotides and/or ribonucleotides, including an aptamer), an amino acid, a peptide, a protein, a sugar, an oligosaccharide, a steroid, a lipid, a folic acid, and a vitamin. The conjugation employs standard chemistry well-known in the art, including but not limited to coupling via N-hydroxysuccinimide, isothiocyanate, DCC (or DCI), and/or any other standard method as described in "Bioconjugate Techniques" by Greg T. Hermanson, Publisher Eslsevier Science, 3rd ed. (2013), the contents of which are incorporated herein by reference in its entirety.

IV. Class 2, Type V CRISPR Proteins for Modifying a Target Nucleic Acid

The present disclosure provides systems comprising a CRISPR nuclease that have utility in genome editing of eukaryotic cells. In some embodiments, the CRISPR nuclease employed in the genome editing systems is a Class 2, Type V nuclease. Although members of Class 2, Type V CRISPR-Cas systems have differences, they share some common characteristics that distinguish them from the Cas9 systems. Firstly, the Class 2, Type V nucleases possess a single RNA-guided RuvC domain-containing effector but no HNH domain, and they recognize TC motif PAM 5' upstream to the target region on the non-targeted strand, which is different from Cas9 systems which rely on G-rich PAM at 3' side of target sequences. Type V nucleases generate staggered double-stranded breaks distal to the PAM sequence, unlike Cas9, which generates a blunt end in the proximal site close to the PAM. In addition, Type V nucleases degrade ssDNA in trans when activated by target dsDNA or ssDNA binding in cis. In some embodiments, the Type V nucleases of the embodiments recognize a 5'-TC PAM motif and produce staggered ends cleaved solely by the RuvC domain. In some embodiments, the Type V nuclease is selected from the group consisting of Cas12a, Cas12b, Cas12c, Cas12d (CasY), Cas12j, Cas12k, C2c4, C2c8, C2c5, C2c10, C2c9, CasZ and CasX. In some embodiments, the present disclosure provides systems comprising a CasX variant protein and one or more gRNA variants (CasX:gRNA system) that are specifically designed to modify a target nucleic acid sequence in eukaryotic cells.

The term "CasX protein", as used herein, refers to a family of proteins, and encompasses all naturally occurring CasX proteins, proteins that share at least 50% identity to naturally occurring CasX proteins, as well as CasX variants possessing one or more improved characteristics relative to a naturally-occurring reference CasX protein or to another CasX variant from which it was derived.

CasX proteins of the disclosure comprise at least one of the following domains: a non-target strand binding (NTSB) domain, a target strand loading (TSL) domain, a helical I domain (which is further divided into helical I-I and I-II subdomains), a helical II domain, an oligonucleotide binding domain (OBD, which is further divided into OBD-I and OBD-II subdomains), and a RuvC DNA cleavage domain (which is further divided into RuvC-I and II subdomains). The RuvC domain may be modified or deleted in a catalytically-dead CasX variant, described more fully, below.

In some embodiments, a CasX protein can bind and/or modify (e.g., nick, catalyze a double-strand break, methylate, demethylate, etc.) a target nucleic acid at a specific sequence targeted by an associated gRNA, which hybridizes to a sequence within the target nucleic acid sequence.

a. Reference CasX Proteins

The disclosure provides naturally-occurring CasX proteins (referred to herein as a "reference CasX protein"), which were subsequently modified to create the CasX variants of the disclosure. For example, reference CasX proteins can be isolated from naturally occurring prokaryotes, such as Deltaproteobacteria, Planctomycetes, or Candidatus Sungbacteria species. A reference CasX protein is a type II CRISPR/Cas endonuclease belonging to the CasX (interchangeably referred to as Cas12e) family of proteins that interacts with a guide RNA to form a ribonucleoprotein (RNP) complex.

In some cases, a reference CasX protein is isolated or derived from Deltaproteobacter having a sequence of:

```
                                                      (SEQ ID NO: 1)
  1 MEKRINKIRK KLSADNATKP VSRSGPMKTL LVRVMTDDLK KRLEKRRKKP EVMPQVISNN

61 AANNLRMLLD DYTKMKEAIL QVYWQEFKDD HVGLMCKFAQ PASKKIDQNK LKPEMDEKGN

121 LTTAGFACSQ CGQPLFVYKL EQVSEKGKAY TNYFGRCNVA EHEKLILLAQ LKPEKDSDEA

181 VTYSLGKFGQ RALDFYSIHV TKESTHPVKP LAQIAGNRYA SGPVGKALSD ACMGTIASFL

241 SKYQDIIIEH QKVVKGNQKR LESLRELAGK ENLEYPSVTL PPQPHTKEGV DAYNEVIARV

301 RMWVNLNLWQ KLKLSRDDAK PLLRLKGFPS FPVVERRENE VDWWNTINEV KKLIDAKRDM

361 GRVFWSGVTA EKRNTILEGY NYLPNENDHK KREGSLENPK KPAKRQFGDL LLYLEKKYAG

421 DWGKVFDEAW ERIDKKIAGL TSHIEREEAR NAEDAQSKAV LTDWLRAKAS FVLERLKEMD

481 EKEFYACEIQ LQKWYGDLRG NPFAVEAENR VVDISGFSIG SDGHSIQYRN LLAWKYLENG

541 KREFYLLMNY GKKGRIRFTD GTDIKKSGKW QGLLYGGGKA KVIDLTFDPD DEQLIILPLA

601 FGTRQGREFI WNDLLSLETG LIKLANGRVI EKTIYNKKIG RDEPALFVAL TFERREVVDP

661 SNIKPVNLIG VDRGENIPAV IALTDPEGCP LPEFKDSSGG PTDILRIGEG YKEKQRAIQA

721 AKEVEQRRAG GYSRKFASKS RNLADDMVRN SARDLFYHAV THDAVLVFEN LSRGFGRQGK

781 RTFMTERQYT KMEDWLTAKL AYEGLTSKTY LSKTLAQYTS KTCSNCGFTI TTADYDGMLV

841 RLKKTSDGWA TTLNNKELKA EGQITYYNRY KRQTVEKELS AELDRLSEES GNNDISKWTK

901 GRRDEALFLL KKRFSHRPVQ EQFVCLDCGH EVHADEQAAL NIARSWLFLN SNSTEFKSYK

961 SGKQPFVGAW QAFYKRRLKE VWKPNA.
```

In some cases, a reference CasX protein is isolated or derived from Planctomycetes having a sequence of:

```
                                                      (SEQ ID NO: 2)
  1 MQEIKRINKI RRRLVKDSNT KKAGKTGPMK TLLVRVMTPD
    LRERLENLRK KPENIPQPIS

61 NTSRANLNKL LTDYTEMKKA ILHVYWEEFQ KDPVGLMSRV
    AQPAPKNIDQ RKLIPVKDGN

121 ERLTSSGFAC SQCCQPLYVY KLEQVNDKGK PHTNYFGRCN
    VSEHERLILL SPHKPEANDE

181 LVTYSLGKFG QRALDFYSIH VTRESNHPVK PLEQIGGNSC
    ASGPVGKALS DACMGAVASF

241 LTKYQDIILE HQKVIKKNEK RLANLKDIAS ANGLAFPKIT
    LPPQPHTKEG IEAYNNVVAQ

301 IVIWVNLNLW QKLKIGRDEA KPLQRLKGFP SFPLVERQAN
    EVDWWDMVCN VKKLINEKKE
```

```
                           -continued
361 DGKVFWQNLA GYKRQEALLP YLSSEEDRKK GKKFARYQFG
    DLLLHLEKKH GEDWGKVYDE

421 AWERIDKKVE GLSKHIKLEE ERRSEDAQSK AALTDWLRAK
    ASFVIEGLKE ADKDEFCRCE

481 LKLQKWYGDL RGKPFAIEAE NSILDISGFS KQYNCAFIWQ
    KDGVKKLNLY LIINYFKGGK

541 LRFKKIKPEA FEANRFYTVI NKKSGEIVPM EVNFNFDDPN
    LIILPLAFGK RQGREFIWND

601 LLSLETGSLK LANGRVIEKT LYNRRTRQDE PALFVALTFE
    RREVLDSSNI KPMNLIGIDR

661 GENIPAVIAL TDPEGCPLSR FKDSLGNPTH ILRIGESYKE
    KQRTIQAAKE VEQRRAGGYS
```

```
                           -continued
721 RKYASKAKNL ADDMVRNTAR DLLYYAVTQD AMLIFENLSR
    GFGRQGKRTF MAERQYTRME

781 DWLTAKLAYE GLPSKTYLSK TLAQYTSKTC SNCGFTITSA
    DYDRVLEKLK KTATGWMTTI

841 NGKELKVEGQ ITYYNRYKRQ NVVKDLSVEL DRLSEESVNN
    DISSWTKGRS GEALSLLKKR

901 FSHRPVQEKF VCLNCGFETH ADEQAALNIA RSWLFLRSQE
    YKKYQTNKTT GNTDKRAFVE

961 TWQSFYRKKL KEVWKPAV.
```

In some cases, a reference CasX protein is isolated or derived from Candidatus Sungbacteria having a sequence of

```
                                                      (SEQ ID NO: 3)
  1 MDNANKPSTK SLVNTTRISD HFGVTPGQVT RVFSFGIIPT
    KRQYAIIERW FAAVEAARER
```

```
 61  LYGMLYAHFQ  ENPPAYLKEK  FSYETFFKGR  PVLNGLRDID
     PTIMTSAVFT  ALRHKAEGAM

121  AAFHTNHRRL  FEEARKKMRE  YAECLKANEA  LLRGAADIDW
     DKIVNALRTR  LNTCLAPEYD

181  AVIADFGALC  AFRALIAETN  ALKGAYNHAL  NQMLPALVKV
     DEPEEAEESP  RLRFFNGRIN

241  DLPKFPVAER  ETPPDTETII  RQLEDMARVI  PDTAEILGYI
     HRIRHKAARR  KPGSAVPLPQ

301  RVALYCAIRM  ERNPEEDPST  VAGHFLGEID  RVCEKRRQGL
     VRTPFDSQIR  ARYMDIISFR

361  ATLAHPDRWT  EIQFLRSNAA  SRRVRAETIS  APFEGFSWTS
     NRTNPAPQYG  MALAKDANAP

421  ADAPELCICL  SPSSAAFSVR  EKGGDLIYMR  PTGGRRGKDN
     PGKEITWVPG  SFDEYPASGV

481  ALKLRLYFGR  SQARRMLTNK  TWGLLSDNPR  VFAANAELVG
     KKRNPQDRWK  LFFHMVISGP

541  PPVEYLDFSS  DVRSRARTVI  GINRGEVNPL  AYAVVSVEDG
     QVLEEGLLGK  KEYIDQLIET

601  RRRISEYQSR  EQTPPRDLRQ  RVRHLQDTVL  GSARAKIHSL
     IAFWKGILAI  ERLDDQFHGR

661  EQKIIPKKTY  LANKTGFMNA  LSFSGAVRVD  KKGNPWGGMI
     EIYPGGISRT  CTQCGTVWLA

721  RRPKNPGHRD  AMVVIPDIVD  DAAATGFDNV  DCDAGTVDYG
     ELFTLSREWV  RLTPRYSRVM

781  RGTLGDLERA  IRQGDDRKSR  QMLELALEPQ  PQWGQFFCHR
     CGFNGQSDVL  AATNLARRAI

841  SLIRRLPDTD  TPPTP.
``` b. Class 2, Type V CasX Variant Proteins

The present disclosure provides Class 2, Type V, CasX variants of a reference CasX protein or variants derived from other CasX variants (see, e.g., FIG. 44) (interchangeably referred to herein as "Class 2, Type V CasX variant", "CasX variant" or "CasX variant protein"), wherein the Class 2, Type V CasX variants comprise at least one modification in at least one domain relative to the reference CasX protein, including but not limited to the sequences of SEQ ID NOS:1-3, or at least one modification relative to another CasX variant. Any change in amino acid sequence of a reference CasX protein or to another CasX variant protein that leads to an improved characteristic of the CasX protein is considered a CasX variant protein of the disclosure. For example, CasX variants can comprise one or more amino acid substitutions, insertions, deletions, or swapped domains, or any combinations thereof, relative to a reference CasX protein sequence.

The CasX variants of the disclosure have one or more improved characteristics compared to a reference CasX protein of SEQ ID NO:1, SEQ ID NO:2 or SEQ ID NO:3, or the variant from which it was derived; e.g. CasX 491 (SEQ ID NO: 336) or CasX 515 (SEQ ID NO: 416). Exemplary improved characteristics of the CasX variant embodiments include, but are not limited to improved folding of the variant, increased binding affinity to the gRNA, increased binding affinity to the target nucleic acid, improved ability to utilize a greater spectrum of PAM sequences in the editing and/or binding of target nucleic acid, improved unwinding of the target DNA, increased editing activity, improved editing efficiency, improved editing specificity for the target nucleic acid, decreased off-target editing or cleavage, increased percentage of a eukaryotic genome that can be efficiently edited, increased activity of the nuclease, increased target strand loading for double strand cleavage, decreased target strand loading for single strand nicking, increased binding of the non-target strand of DNA, improved protein stability, improved protein:gRNA (RNP) complex stability, and improved fusion characteristics. In the foregoing embodiments, the one or more of the improved characteristics of the CasX variant is at least about 1.1 to about 100,000-fold improved relative to the reference CasX protein of SEQ ID NO: 1, SEQ ID NO: 2, or SEQ ID NO: 3, or CasX 491 (SEQ ID NO: 336) or CasX 515 (SEQ ID NO: 416), when assayed in a comparable fashion. In other embodiments, the improvement is at least about 1.1-fold, at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the reference CasX protein of SEQ ID NO: 1, SEQ ID NO: 2, or SEQ ID NO: 3, or CasX 491 or CasX 515. when assayed in a comparable fashion. In other cases, the one or more improved characteristics of an RNP of the CasX variant and the gRNA variant are at least about 1.1, at least about 10, at least about 100, at least about 1000, at least about 10,000, at least about 100,000-fold or more improved relative to an RNP of the reference CasX protein of SEQ ID NO:1, SEQ ID NO:2, or SEQ ID NO:3 and the gRNA of Table 1 or CasX 491 or CasX 515 with gRNA 174. In other cases, the one or more of the improved characteristics of an RNP of the CasX variant and the gRNA variant are about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to an RNP of the reference CasX protein of SEQ ID NO:1, SEQ ID NO:2, or SEQ ID NO:3 and the gRNA of Table 1, or CasX 491 or CasX 515 with gRNA 174, when assayed in a comparable fashion. In other cases, the one or more improved characteristics of an RNP of the CasX variant and the gRNA variant are about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to an RNP of the reference CasX protein of SEQ ID NO:1, SEQ ID NO:2, or SEQ ID NO:3 and the gRNA of Table 1, or CasX 491 or CasX 515 with gRNA 174, when assayed in a comparable fashion.

In some embodiments, the modification of the CasX variant is a mutation in one or more amino acids of the reference CasX. In other embodiments, the modification is an insertion or substitution of a part or all of a domain from a different CasX protein. In a particular embodiment, the CasX variants of SEQ ID NOS: 415-592 and 1147-1231 have a NTSB and helical 1B domain of SEQ ID NO: 1, while the other domains are derived from SEQ ID NO: 2, in addition to individual modifications in select domains, described herein. Mutations can be introduced in any one or more domains of the reference CasX protein or in a CasX variant to result in a CasX variant, and may include, for example, deletion of part or all of one or more domains, or one or more amino acid substitutions, deletions, or insertions in any domain of the reference CasX protein or the CasX variant from which it was derived. The domains of CasX proteins include the non-target strand binding (NTSB) domain, the target strand loading (TSL) domain, the Helical I domain, the Helical II domain, the oligonucleotide binding domain (OBD), and the RuvC DNA cleavage domain. Without being bound to theory or mechanism, a NTSB domain in a CasX allows for binding to the non-target nucleic acid strand and may aid in unwinding of the non-target and target strands. The NTSB domain is presumed to be responsible for the unwinding, or the capture, of a non-target nucleic acid strand in the unwound state. An exemplary NTSB domain comprises amino acids 100-190 of SEQ ID NO: 1 or amino acids 102-191 of SEQ ID NO: 2. In some embodiments, the NTSB domain of a reference CasX protein comprises a four-stranded beta sheet. In some embodiments, the TSL acts to place or capture the target-strand in a folded state that places the scissile phosphate of the target strand DNA backbone in the RuvC active site. An exemplary TSL comprises amino acids 824-933 of SEQ ID NO: 1 or amino acids 811-920 of SEQ ID NO: 2. Without wishing to be bound by theory, it is thought that in some cases the Helical I domain may contribute to binding of the protospacer adjacent motif (PAM). In some embodiments, the Helical I domain of a reference CasX protein comprises one or more alpha helices. Exemplary Helical I_I and I-II domains comprise amino acids 56-99 and 191-331 of SEQ ID NO: 1, respectively, or amino acids 58-101 and 192-332 of SEQ ID NO: 2, respectively. The Helical II domain is responsible for binding to the guide RNA scaffold stem loop as well as the bound DNA. An exemplary Helical II domain comprises amino acids 332-508 of SEQ ID NO: 1, or amino acids 333-500 of SEQ ID NO: 2. The OBD largely binds the RNA triplex of the guide RNA scaffold. The OBD may also be responsible for binding to the protospacer adjacent motif (PAM). Exemplary OBD I and II domains comprise amino acids 1-55 and 509-659 of SEQ ID NO: 1, respectively, or amino acids 1-57 and 501-646 of SEQ ID NO: 2, respectively. The RuvC has a DED motif active site that is responsible for cleaving both strands of DNA (one by one, most likely the non-target strand first at 11-14 nucleotides (nt) into the targeted sequence and then the target strand next at 2-4 nucleotides after the target sequence, resulting in a staggered cut). Specifically in CasX, the RuvC domain is unique in that it is also responsible for binding the guide RNA scaffold stem loop that is critical for CasX function. Exemplary RuvC I and II domains comprise amino acids 660-823 and 934-986 of SEQ ID NO: 1, respectively, or amino acids 647-810 and 921-978 of SEQ ID NO: 2, respectively, while CasX variants may comprise mutations at positions 1658 and A708 relative to SEQ ID NO: 2, or the mutations of CasX 515, described below.

In some embodiments, the CasX variant protein comprises at least one modification in at least 1 domain, in at least each of 2 domains, in at least each of 3 domains, in at least each of 4 domains or in at least each of 5 domains of the reference CasX protein, including the sequences of SEQ ID NOS: 1-3. In some embodiments, the CasX variant protein comprises two or more modifications in at least one domain of the reference CasX protein. In some embodiments, the CasX variant protein comprises at least two modifications in at least one domain of the reference CasX protein, at least three modifications in at least one domain of the reference CasX protein or at least four or more modifications in at least one domain of the reference CasX protein. In some embodiments, wherein the CasX variant comprises two or more modifications compared to a reference CasX protein, and each modification is made in a domain independently selected from the group consisting of a NTSB, TSL, Helical I domain, Helical II domain, OBD, and RuvC DNA cleavage domain. In some embodiments, wherein the CasX variant comprises two or more modifications compared to a reference CasX protein, a modification is made in two or more domains. In some embodiments, the at least one modification of the CasX variant protein comprises a deletion of at least a portion of one domain of the reference CasX protein of SEQ ID NOS: 1-3. In some embodiments, the deletion is in the NTSB domain, TSL domain, Helical I domain, Helical II domain, OBD, or RuvC DNA cleavage domain.

In some cases, the CasX variants of the disclosure comprise modifications in structural regions that may encompass one or more domains. In some embodiments, a CasX variant comprises at least one modification of a region of non-contiguous amino acid residues of the CasX variant that form a channel in which gRNA:target nucleic acid complexing with the CasX variant occurs. In other embodiments, a CasX variant comprises at least one modification of a region of non-contiguous amino acid residues of the CasX variant that form an interface which binds with the gRNA. In other embodiments, a CasX variant comprises at least one modification of a region of non-contiguous amino acid residues of the CasX variant that form a channel which binds with the non-target strand DNA. In other embodiments, a CasX variant comprises at least one modification of a region of non-contiguous amino acid residues of the CasX variant that form an interface which binds with the protospacer adjacent motif (PAM) of the target nucleic acid. In other embodiments, a CasX variant comprises at least one modification of a region of non-contiguous surface-exposed amino acid residues of the CasX variant. In other embodiments, a CasX variant comprises at least one modification of a region of non-contiguous amino acid residues that form a core through hydrophobic packing in a domain of the CasX variant. In the foregoing embodiments of the paragraph, the modifications of the region can comprise one or more of a deletion, an insertion, or a substitution of one or more amino acids of the region; or between 2 to 15 amino acid residues of the region of the CasX variant are substituted with charged amino acids; or between 2 to 15 amino acid residues of a region of the CasX variant are substituted with polar amino acids; or between 2 to 15 amino acid residues of a region of the CasX variant are substituted with amino acids that stack, or have affinity with DNA or RNA bases.

In other embodiments, the disclosure provides CasX variants wherein the CasX variants comprise at least one modification relative to another CasX variant; e.g., CasX variant 515 and 527 is a variant of CasX variant 491 and CasX variants 668 and 672 are variants of CasX 535 (see, FIG. 44). In some embodiments, the at least one modification is selected from the group consisting of an amino acid insertion, deletion, or substitution. All variants that improve one or more functions or characteristics of the CasX variant protein when compared to a reference CasX protein or the variant from which it was derived described herein are envisaged as being within the scope of the disclosure. As described in the Examples, a CasX variant can be mutagenized to create another CasX variant. In a particular embodiment, the disclosure provides, in Example 14, variants of CasX 515 (SEQ ID NO: 416) created by introducing modifications to the encoding sequence resulting in amino acid substitutions, deletions, or insertions at one or more positions in one or more domains.

Suitable mutagenesis methods for generating CasX variant proteins of the disclosure may include, for example, Deep Mutational Evolution (DME), deep mutational scanning (DMS), error prone PCR, cassette mutagenesis, random mutagenesis, staggered extension PCR, gene shuffling, or domain swapping (described in PCT/US20/36506 and WO2020247883A2, incorporated by reference herein). In some embodiments, the CasX variants are designed, for example by selecting multiple desired mutations in a CasX variant identified, for example, using the assays described in the Examples. In certain embodiments, the activity of a reference CasX or the CasX variant protein prior to mutagenesis is used as a benchmark against which the activity of one or more resulting CasX variants are compared, thereby measuring improvements in function of the new CasX variants.

In some embodiments of the CasX variants described herein, the at least one modification comprises: (a) a substitution of 1 to 100 consecutive or non-consecutive amino acids in the CasX variant compared to a reference CasX of SEQ ID NO:1, SEQ ID NO:2, SEQ ID NO:3, CasX variant 491 (SEQ ID NO: 336) or CasX variant 515 (SEQ ID NO: 416); (b) a deletion of 1 to 100 consecutive or non-consecutive amino acids in the CasX variant compared to a reference CasX or the variant from which it was derived; (c) an insertion of 1 to 100 consecutive or non-consecutive amino acids in the CasX compared to a reference CasX or the variant from which it was derived; or (d) any combination of (a)-(c). In some embodiments, the at least one modification comprises: (a) a substitution of 1-10 consecutive or non-consecutive amino acids in the CasX variant compared to a reference CasX of SEQ ID NO:1, SEQ ID NO:2, SEQ ID NO:3, or the variant from which it was derived; (b) a deletion of 1-5 consecutive or non-consecutive amino acids in the CasX variant compared to a reference CasX or the variant from which it was derived; (c) an insertion of 1-5 consecutive or non-consecutive amino acids in the CasX compared to a reference CasX or the variant from which it was derived; or (d) any combination of (a)-(c).

In some embodiments, the CasX variant protein comprises or consists of a sequence that has at least 1, at least 2, at least 3, at least 4, at least 5, at least 6, at least 7, at least 8, at least 9, at least 10, at least 20, at least 30, at least 40, at least 50, at least 60, at least 70, at lease 80, at least 90, or at least 100 alterations relative to the sequence of SEQ ID NO:1, SEQ ID NO:2, SEQ ID NO:3, CasX 491 or CasX 515. In some embodiments, the CasX variant protein comprises one more substitutions relative to CasX 491, or SEQ ID NO: 336. In some embodiments, the CasX variant protein comprises one more substitutions relative to CasX 515, or SEQ ID NO: 416. These alterations can be amino acid insertions, deletions, substitutions, or any combinations thereof. The alterations can be in one domain or in any domain or any combination of domains of the CasX variant. Any amino acid can be substituted for any other amino acid in the substitutions described herein. The substitution can be a conservative substitution (e.g., a basic amino acid is substituted for another basic amino acid). The substitution can be a non-conservative substitution (e.g., a basic amino acid is substituted for an acidic amino acid or vice versa). For example, a proline in a reference CasX protein can be substituted for any of arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine to generate a CasX variant protein of the disclosure.

Any permutation of the substitution, insertion and deletion embodiments described herein can be combined to generate a CasX variant protein of the disclosure. For example, a CasX variant protein can comprise at least one substitution and at least one deletion relative to a reference CasX protein sequence or a sequence of CasX 491 or CasX 515, at least one substitution and at least one insertion relative to a reference CasX protein sequence or a sequence of CasX 491 or CasX 515, at least one insertion and at least one deletion relative to a reference CasX protein sequence or a sequence of CasX 491 or CasX 515, or at least one substitution, one insertion and one deletion relative to a reference CasX protein sequence or a sequence of CasX 491 or CasX 515.

In some embodiments, the CasX variant protein comprises between 400 and 2000 amino acids, between 500 and 1500 amino acids, between 700 and 1200 amino acids, between 800 and 1100 amino acids, or between 900 and 1000 amino acids.

In some embodiments, a CasX variant protein comprises a sequence of SEQ ID NOS: 247-592 or 1147-1231 as set forth in Table 3. In some embodiments, a CasX variant protein consists of a sequence of SEQ ID NOS: 247-592 or 1147-1231 as set forth in Table 3. In other embodiments, a CasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 247-592 and 1147-1231 as set forth in Table 3. In some embodiments, a CasX variant protein comprises or consists of a sequence of SEQ ID NOS: 270-592 or 1147-1231. In other embodiments, a CasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 270-592 or 1147-

1231. In some embodiments, a CasX variant protein comprises or consists of a sequence of SEQ ID NOS: 415-592 or 1147-1231. In other embodiments, a CasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 416-592 or 1147-1231. (ND=not described, or otherwise not provided).

TABLE 3

CasX Variant Sequences

| SEQ ID NO | Variant No. | Description of Variant |
|---|---|---|
| 247 | ND | TSL, Helical I, Helical II, OBD and RuvC domains from SEQ ID NO: 2 and an NTSB domain from SEQ ID NO: 1 |
| 248 | ND | NTSB, Helical I, Helical II, OBD and RuvC domains from SEQ ID NO: 2 and a TSL domain from SEQ ID NO: 1. |
| 249 | ND | TSL, Helical I, Helical II, OBD and RuvC domains from SEQ ID NO: 1 and an NTSB domain from SEQ ID NO: 2 |
| 250 | ND | NTSB, Helical I, Helical II, OBD and RuvC domains from SEQ ID NO: 1 and an TSL domain from SEQ ID NO: 2. |
| 251 | ND | NTSB, TSL, Helical I, Helical II and OBD domains SEQ ID NO: 2 and an exogenous RuvC domain or a portion thereof from a second CasX protein. |
| 252 | ND | No description |
| 253 | ND | NTSB, TSL, Helical II, OBD and RuvC domains from SEQ ID NO: 2 and a Helical I domain from SEQ ID NO: 1 |
| 254 | ND | NTSB, TSL, Helical I, OBD and RuvC domains from SEQ ID NO: 2 and a Helical II domain from SEQ ID NO: 1 |
| 255 | ND | NTSB, TSL, Helical I, Helical II and RuvC domains from a first CasX protein and an exogenous OBD or a part thereof from a second CasX protein |
| 256 | ND | No description |
| 257 | ND | No description |
| 258 | ND | substitution of L379R, a substitution of C477K, a substitution of A708K, a deletion of P at position 793 and a substitution of T620P of SEQ ID NO: 2 |
| 259 | ND | substitution of M771A of SEQ ID NO: 2. |
| 260 | ND | substitution of L379R, a substitution of A708K, a deletion of P at position 793 and a substitution of D732N of SEQ ID NO: 2. |
| 261 | ND | substitution of W782Q of SEQ ID NO: 2. |
| 262 | ND | substitution of M771Q of SEQ ID NO: 2 |
| 263 | ND | substitution of R458I and a substitution of A739V of SEQ ID NO: 2. |
| 264 | ND | L379R, a substitution of A708K, a deletion of P at position 793 and a substitution of M771N of SEQ ID NO: 2 |
| 265 | ND | substitution of L379R, a substitution of A708K, a deletion of P at position 793 and a substitution of A739T of SEQ ID NO: 2 |
| 266 | ND | substitution of L379R, a substitution of C477K, a substitution of A708K, a deletion of P at position 793 and a substitution of D489S of SEQ ID NO: 2. |
| 267 | ND | substitution of L379R, a substitution of C477K, a substitution of A708K, a deletion of P at position 793 and a substitution of D732N of SEQ ID NO: 2. |
| 268 | ND | substitution of V711K of SEQ ID NO: 2. |
| 269 | ND | substitution of L379R, a substitution of C477K, a substitution of A708K, a deletion of P at position 793 and a substitution of Y797L of SEQ ID NO: 2. |
| 270 | 119 | ND |
| 283 | 429 | ND |
| 284 | 430 | ND |
| 285 | 431 | ND |
| 286 | 432 | ND |
| 287 | 433 | ND |
| 288 | 434 | ND |
| 289 | 435 | ND |
| 290 | 436 | ND |
| 291 | 437 | ND |
| 292 | 438 | ND |
| 293 | 439 | ND |
| 294 | 440 | ND |
| 295 | 441 | ND |
| 296 | 442 | ND |
| 297 | 443 | ND |
| 298 | 444 | ND |
| 299 | 445 | ND |
| 300 | 446 | ND |
| 301 | 447 | ND |
| 302 | 448 | ND |
| 303 | 449 | ND |
| 304 | 450 | ND |
| 305 | 451 | ND |
| 306 | 452 | ND |
| 307 | 453 | ND |

TABLE 3-continued

CasX Variant Sequences

| SEQ ID NO | Variant No. | Description of Variant |
|---|---|---|
| 308 | 454 | ND |
| 309 | 455 | ND |
| 310 | 456 | ND |
| 311 | 457 | ND |
| 312 | 458 | ND |
| 313 | 459 | ND |
| 314 | 460 | ND |
| 315 | 278 | ND |
| 316 | 279 | ND |
| 317 | 280 | ND |
| 318 | 285 | ND |
| 319 | 286 | ND |
| 320 | 287 | ND |
| 321 | 288 | ND |
| 322 | 290 | ND |
| 323 | 291 | ND |
| 324 | 293 | ND |
| 325 | 300 | ND |
| 326 | 492 | ND |
| 327 | 493 | ND |
| 328 | 387 | ND |
| 329 | 395 | ND |
| 330 | 485 | ND |
| 331 | 486 | ND |
| 332 | 487 | ND |
| 333 | 488 | ND |
| 334 | 489 | ND |
| 335 | 490 | ND |
| 336 | 491 | ND |
| 337 | 494 | ND |
| 411 | 328 | ND |
| 412 | 388 | ND |
| 413 | 389 | ND |
| 414 | 390 | ND |
| 415 | 514 | ND |
| 416 | 515 | ND |
| 417 | 516 | ND |
| 418 | 517 | ND |
| 419 | 518 | ND |
| 420 | 519 | ND |
| 421 | 520 | ND |
| 422 | 522 | ND |
| 423 | 523 | ND |
| 424 | 524 | ND |
| 425 | 525 | ND |
| 426 | 526 | ND |
| 427 | 527 | ND |
| 428 | 528 | ND |
| 429 | 529 | ND |
| 430 | 530 | ND |
| 431 | 531 | ND |
| 432 | 532 | ND |
| 433 | 533 | ND |
| 434 | 534 | ND |
| 435 | 535 | ND |
| 436 | 536 | ND |
| 437 | 537 | ND |
| 438 | 538 | ND |
| 439 | 539 | ND |
| 440 | 540 | ND |
| 441 | 541 | ND |
| 442 | 542 | ND |
| 443 | 543 | ND |
| 444 | 544 | ND |
| 445 | 545 | ND |
| 446 | 546 | ND |
| 447 | 547 | ND |
| 448 | 548 | ND |
| 449 | 550 | ND |
| 450 | 551 | ND |
| 451 | 552 | ND |
| 452 | 553 | ND |
| 453 | 554 | ND |
| 454 | 555 | ND |
| 455 | 556 | ND |

TABLE 3-continued

CasX Variant Sequences

| SEQ ID NO | Variant No. | Description of Variant |
|---|---|---|
| 456 | 557 | ND |
| 457 | 558 | ND |
| 458 | 559 | ND |
| 459 | 560 | ND |
| 460 | 561 | ND |
| 461 | 562 | ND |
| 462 | 563 | ND |
| 563 | 564 | ND |
| 464 | 565 | ND |
| 465 | 566 | ND |
| 466 | 567 | ND |
| 467 | 568 | ND |
| 468 | 569 | ND |
| 469 | 570 | ND |
| 470 | 571 | ND |
| 471 | 572 | ND |
| 472 | 573 | ND |
| 473 | 574 | ND |
| 474 | 575 | ND |
| 475 | 576 | ND |
| 476 | 577 | ND |
| 477 | 578 | ND |
| 478 | 579 | ND |
| 479 | 580 | ND |
| 480 | 581 | ND |
| 481 | 582 | ND |
| 482 | 583 | ND |
| 483 | 584 | ND |
| 484 | 585 | ND |
| 485 | 586 | ND |
| 486 | 587 | ND |
| 487 | 588 | ND |
| 488 | 589 | ND |
| 489 | 590 | ND |
| 490 | 591 | ND |
| 491 | 592 | ND |
| 492 | 593 | ND |
| 493 | 594 | ND |
| 494 | 595 | ND |
| 495 | 596 | ND |
| 496 | 597 | ND |
| 497 | 598 | ND |
| 498 | 599 | ND |
| 499 | 600 | ND |
| 500 | 601 | ND |
| 501 | 602 | ND |
| 502 | 603 | ND |
| 503 | 604 | ND |
| 504 | 605 | ND |
| 505 | 606 | ND |
| 506 | 607 | ND |
| 507 | 608 | ND |
| 508 | 609 | ND |
| 509 | 610 | ND |
| 510 | 611 | ND |
| 511 | 612 | ND |
| 512 | 613 | ND |
| 513 | 614 | ND |
| 514 | 615 | ND |
| 515 | 616 | ND |
| 516 | 617 | ND |
| 517 | 618 | ND |
| 518 | 619 | ND |
| 519 | 620 | ND |
| 520 | 621 | ND |
| 521 | 622 | ND |
| 522 | 623 | ND |
| 523 | 624 | ND |
| 524 | 625 | ND |
| 525 | 626 | ND |
| 526 | 627 | ND |
| 527 | 628 | ND |
| 528 | 629 | ND |
| 529 | 630 | ND |
| 530 | 631 | ND |

TABLE 3-continued

CasX Variant Sequences

| SEQ ID NO | Variant No. | Description of Variant |
|---|---|---|
| 531 | 632 | ND |
| 532 | 633 | ND |
| 533 | 634 | ND |
| 534 | 635 | ND |
| 535 | 636 | ND |
| 536 | 637 | ND |
| 537 | 638 | ND |
| 538 | 639 | ND |
| 539 | 640 | ND |
| 540 | 641 | ND |
| 541 | 642 | ND |
| 542 | 643 | ND |
| 543 | 644 | ND |
| 544 | 645 | ND |
| 545 | 646 | ND |
| 546 | 647 | ND |
| 547 | 648 | ND |
| 548 | 649 | ND |
| 549 | 650 | ND |
| 550 | 651 | ND |
| 551 | 652 | ND |
| 552 | 653 | ND |
| 553 | 654 | ND |
| 554 | 655 | ND |
| 555 | 656 | ND |
| 556 | 657 | ND |
| 557 | 658 | ND |
| 558 | 659 | ND |
| 559 | 660 | ND |
| 560 | 661 | ND |
| 561 | 662 | ND |
| 562 | 663 | ND |
| 563 | 664 | ND |
| 564 | 665 | ND |
| 565 | 666 | ND |
| 566 | 667 | ND |
| 567 | 668 | ND |
| 568 | 669 | ND |
| 569 | 671 | ND |
| 570 | 672 | ND |
| 571 | 673 | ND |
| 572 | 674 | ND |
| 573 | 675 | ND |
| 574 | 676 | ND |
| 575 | 677 | ND |
| 576 | 678 | ND |
| 577 | 679 | ND |
| 578 | 680 | ND |
| 579 | 681 | ND |
| 580 | 682 | ND |
| 581 | 683 | ND |
| 582 | 684 | ND |
| 583 | 685 | ND |
| 584 | 686 | ND |
| 585 | 687 | ND |
| 586 | 688 | ND |
| 587 | 689 | ND |
| 588 | 690 | ND |
| 589 | 691 | ND |
| 590 | 692 | ND |
| 591 | 693 | ND |
| 592 | 694 | ND |
| 1147 | 701 | ND |
| 1148 | 702 | ND |
| 1149 | 703 | ND |
| 1150 | 704 | ND |
| 1151 | 705 | ND |
| 1152 | 706 | ND |
| 1153 | 707 | ND |
| 1154 | 708 | ND |
| 1155 | 709 | ND |
| 1156 | 710 | ND |
| 1157 | 711 | ND |
| 1158 | 712 | ND |
| 1159 | 713 | ND |

TABLE 3-continued

CasX Variant Sequences

| SEQ ID NO | Variant No. | Description of Variant |
|---|---|---|
| 1160 | 714 | ND |
| 1161 | 715 | ND |
| 1162 | 716 | ND |
| 1163 | 717 | ND |
| 1164 | 718 | ND |
| 1165 | 719 | ND |
| 1166 | 720 | ND |
| 1167 | 721 | ND |
| 1168 | 722 | ND |
| 1169 | 723 | ND |
| 1170 | 724 | ND |
| 1171 | 725 | ND |
| 1172 | 726 | ND |
| 1173 | 727 | ND |
| 1174 | 728 | ND |
| 1175 | 729 | ND |
| 1176 | 730 | ND |
| 1177 | 731 | ND |
| 1178 | 732 | ND |
| 1179 | 733 | ND |
| 1180 | 734 | ND |
| 1181 | 735 | ND |
| 1182 | 736 | ND |
| 1183 | 737 | ND |
| 1184 | 738 | ND |
| 1185 | 739 | ND |
| 1186 | 740 | ND |
| 1187 | 741 | ND |
| 1188 | 742 | ND |
| 1189 | 743 | ND |
| 1190 | 744 | ND |
| 1191 | 745 | ND |
| 1192 | 746 | ND |
| 1193 | 747 | ND |
| 1194 | 748 | ND |
| 1195 | 749 | ND |
| 1196 | 750 | ND |
| 1197 | 751 | ND |
| 1198 | 752 | ND |
| 1199 | 753 | ND |
| 1200 | 754 | ND |
| 1201 | 755 | ND |
| 1202 | 756 | ND |
| 1203 | 757 | ND |
| 1204 | 758 | ND |
| 1205 | 759 | ND |
| 1206 | 760 | ND |
| 1207 | 761 | ND |
| 1208 | 762 | ND |
| 1209 | 763 | ND |
| 1210 | 764 | ND |
| 1211 | 765 | ND |
| 1212 | 766 | ND |
| 1213 | 767 | ND |
| 1214 | 768 | ND |
| 1215 | 769 | ND |
| 1216 | 770 | ND |
| 1217 | 777 | ND |
| 1218 | 778 | ND |
| 1219 | 779 | ND |
| 1220 | 780 | ND |
| 1221 | 781 | ND |
| 1222 | 782 | ND |
| 1223 | 783 | ND |
| 1224 | 784 | ND |
| 1225 | 785 | ND |
| 1226 | 786 | ND |
| 1227 | 787 | ND |
| 1228 | 788 | ND |
| 1229 | 789 | ND |
| 1230 | 790 | ND |
| 1231 | 791 | ND | c. CasX Variant Proteins with Domains from Multiple Source Proteins

In certain embodiments, the disclosure provides a chimeric CasX protein comprising protein domains from two or more different CasX proteins, such as two or more naturally occurring CasX proteins, or two or more CasX variant protein sequences as described herein. As used herein, a "chimeric CasX protein" refers to a CasX containing at least two domains isolated or derived from different sources, such as two naturally occurring proteins, which may, in some embodiments, be isolated from different species. For example, in some embodiments, a chimeric CasX protein comprises a first domain from a first CasX protein and a second domain from a second, different CasX protein. In some embodiments, the first domain can be selected from the group consisting of the NTSB, TSL, helical I, helical II, OBD and RuvC domains. In some embodiments, the second domain is selected from the group consisting of the NTSB, TSL, helical I, helical II, OBD and RuvC domains with the second domain being different from the foregoing first domain. In a particular embodiment, the CasX variants of 514-791 (SEQ ID NOS: 415-592 and 1147-1231) have a NTSB and helical 1B domain derived from the sequence of SEQ ID NO: 1, while the other domains are derived from SEQ ID NO: 2, it being understood that the variants have additional amino acid changes at select locations.

d. Protein Affinity for the gRNA

In some embodiments, a CasX variant protein has improved affinity for the gRNA relative to a reference CasX protein, leading to the formation of the ribonucleoprotein complex (RNP). Increased affinity of the CasX variant protein for the gRNA may, for example, result in a lower $K_d$ for the generation of a RNP complex, which can, in some cases, result in a more stable ribonucleoprotein complex formation. In some embodiments, increased affinity of the CasX variant protein for the gRNA results in increased stability of the ribonucleoprotein complex when delivered to human cells. This increased stability can affect the function and utility of the complex in the cells of a subject, as well as result in improved pharmacokinetic properties in blood, when delivered to a subject. In some embodiments, increased affinity of the CasX variant protein, and the resulting increased stability of the ribonucleoprotein complex, allows for a lower dose of the CasX variant protein to be delivered to the subject or cells while still having the desired activity, for example in vivo or in vitro gene editing. In some embodiments, a higher affinity (tighter binding) of a CasX variant protein to a gRNA allows for a greater amount of editing events when both the CasX variant protein and the gRNA remain in an RNP complex. Increased editing events can be assessed using editing assays such as the tdTom editing assays described herein. In some embodiments, the $K_d$ of a CasX variant protein for a gRNA is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant has about 1.1 to about 10-fold increased binding affinity to the gRNA compared to the reference CasX protein of SEQ ID NO: 2.

In some embodiments, increased affinity of the CasX variant protein for the gRNA results in increased stability of the ribonucleoprotein complex when delivered to mammalian cells, including in vivo delivery to a subject. This increased stability can affect the function and utility of the complex in the cells of a subject, as well as result in improved pharmacokinetic properties in blood, when delivered to a subject. In some embodiments, increased affinity of the CasX variant protein, and the resulting increased stability of the ribonucleoprotein complex, allows for a lower dose of the CasX variant protein to be delivered to the subject or cells while still having the desired activity; for example in vivo or in vitro gene editing. The increased ability to form RNP and keep them in stable form can be assessed using assays such as the in vitro cleavage assays described in the Examples herein. In some embodiments, RNP comprising the CasX variants of the disclosure are able to achieve a $k_{cleave}$ rate when complexed as an RNP that is at last 2-fold, at least 5-fold, or at least 10-fold higher compared to RNP comprising a reference CasX of SEQ ID NOS: 1-3.

In some embodiments, a higher affinity (tighter binding) of a CasX variant protein to a gRNA allows for a greater amount of editing events when both the CasX variant protein and the gRNA remain in an RNP complex. Increased editing events can be assessed using editing assays such as the assays described herein.

Without wishing to be bound by theory, in some embodiments amino acid changes in the helical I domain can increase the binding affinity of the CasX variant protein with the gRNA targeting sequence, while changes in the helical II domain can increase the binding affinity of the CasX variant protein with the gRNA scaffold stem loop, and changes in the oligonucleotide binding domain (OBD) increase the binding affinity of the CasX variant protein with the gRNA triplex.

Methods of measuring CasX protein binding affinity for a gRNA include in vitro methods using purified CasX protein and gRNA. The binding affinity for reference CasX and variant proteins can be measured by fluorescence polarization if the gRNA or CasX protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference CasX and variant proteins of the disclosure for specific gRNAs such as reference gRNAs and variants thereof include, but are not limited to, isothermal calorimetry (ITC), and surface plasmon resonance (SPR), as well as the methods of the Examples.

catalytically-deadIn some embodiments, the CasX variant protein comprises one or more modifications in a region of non-contiguous residues that form a channel in which gRNA:target nucleic acid complexing occurs. In some embodiments, the CasX variant protein comprises one or more modifications comprising a region of non-contiguous residues that form an interface which binds with the gRNA. For example, in some embodiments of a reference CasX protein, the helical I, helical II and OBD domains all contact or are in proximity to the gRNA:target nucleic acid complex, and one or more modifications to non-contiguous residues within any of these domains may improve function of the CasX variant protein.

In some embodiments, the CasX variant protein comprises one or more modifications in a region of non-contiguous residues that form a channel which binds with the non-target strand DNA. For example, a CasX variant protein can comprise one or more modifications to non-contiguous residues of the NTSB domain. In some embodiments, the CasX variant protein comprises one or more modifications in a region of non-contiguous residues that form an interface which binds with the PAM. For example, a CasX variant protein can comprise one or more modifications to non-contiguous residues of the helical I domain or OBD. In some embodiments, the CasX variant protein comprises one or more modifications comprising a region of non-contiguous surface-exposed residues. As used herein, "surface-exposed residues" refers to amino acids on the surface of the CasX protein, or amino acids in which at least a portion of the amino acid, such as the backbone or a part of the side chain is on the surface of the protein. Surface exposed residues of cellular proteins such as CasX, which are exposed to an aqueous intracellular environment, are frequently selected from positively charged hydrophilic amino acids, for example arginine, asparagine, aspartate, glutamine, glutamate, histidine, lysine, serine, and threonine. Thus, for example, in some embodiments of the variants provided herein, a region of surface exposed residues comprises one or more insertions, deletions, or substitutions compared to a reference CasX protein. In some embodiments, one or more positively charged residues are substituted for one or more other positively charged residues, or negatively charged residues, or uncharged residues, or any combinations thereof. In some embodiments, one or more amino acids residues for substitution are near bound nucleic acid, for example residues in the RuvC domain or helical I domain that contact target nucleic acid, or residues in the OBD or helical II domain that bind the gRNA, can be substituted for one or more positively charged or polar amino acids.

In some embodiments, the CasX variant protein comprises one or more modifications in a region of non-contiguous residues that form a core through hydrophobic packing in a domain of the reference CasX protein. Without wishing to be bound by any theory, regions that form cores through hydrophobic packing are rich in hydrophobic amino acids such as valine, isoleucine, leucine, methionine, phenylalanine, tryptophan, and cysteine. For example, in some reference CasX proteins, RuvC domains comprise a hydrophobic pocket adjacent to the active site. In some embodiments, between 2 to 15 residues of the region are charged, polar, or base-stacking. Charged amino acids (sometimes referred to herein as residues) may include, for example, arginine, lysine, aspartic acid, and glutamic acid, and the side chains of these amino acids may form salt bridges provided a bridge partner is also present (see FIG. 14). Polar amino acids may include, for example, glutamine, asparagine, histidine, serine, threonine, tyrosine, and cysteine. Polar amino acids can, in some embodiments, form hydrogen bonds as proton donors or acceptors, depending on the identity of their side chains. As used herein, "base-stacking" includes the interaction of aromatic side chains of an amino acid residue (such as tryptophan, tyrosine, phenylalanine, or histidine) with stacked nucleotide bases in a nucleic acid. Any modification to a region of non-contiguous amino acids that are in close spatial proximity to form a functional part of the CasX variant protein is envisaged as within the scope of the disclosure.

e. CasX Variant Proteins with Domains from Multiple Source Proteins

In certain embodiments, the disclosure provides a chimeric CasX variant protein comprising protein domains from two or more different CasX proteins, such as two or more naturally occurring CasX proteins, or two or more CasX variant protein sequences as described herein. As used herein, a "chimeric CasX protein" refers to a CasX containing at least two domains isolated or derived from different sources, such as two naturally occurring proteins, which may, in some embodiments, be isolated from different species. For example, in some embodiments, a chimeric CasX protein comprises a first domain from a first CasX protein and a second domain from a second, different CasX protein. In some embodiments, the first domain can be selected from the group consisting of the NTSB, TSL, helical I, helical II, OBD and RuvC domains. In some embodiments, the second domain is selected from the group consisting of the NTSB, TSL, helical I, helical II, OBD and RuvC domains with the second domain being different from the foregoing first domain. For example, a chimeric CasX protein may comprise an NTSB, TSL, helical I, helical II, OBD domains from a CasX protein of SEQ ID NO: 2, and a RuvC domain from a CasX protein of SEQ ID NO: 1, or vice versa. As a further example, a chimeric CasX protein may comprise an NTSB, TSL, helical II, OBD and RuvC domain from CasX protein of SEQ ID NO: 2, and a helical I domain from a CasX protein of SEQ ID NO: 1, or vice versa. Thus, in certain embodiments, a chimeric CasX protein may comprise an NTSB, TSL, helical II, OBD and RuvC domain from a first CasX protein, and a helical I domain from a second CasX protein. In some embodiments of the chimeric CasX proteins, the domains of the first CasX protein are derived from the sequences of SEQ ID NO: 1, SEQ ID NO: 2 or SEQ ID NO: 3, and the domains of the second CasX protein are derived from the sequences of SEQ ID NO: 1, SEQ ID NO: 2 or SEQ ID NO: 3, and the first and second CasX proteins are not the same. In some embodiments, domains of the first CasX protein comprise sequences derived from SEQ ID NO: 1 and domains of the second CasX protein comprise sequences derived from SEQ ID NO: 2. In some embodiments, domains of the first CasX protein comprise sequences derived from SEQ ID NO: 1 and domains of the second CasX protein comprise sequences derived from SEQ ID NO: 3. In some embodiments, domains of the first CasX protein comprise sequences derived from SEQ ID NO: 2 and domains of the second CasX protein comprise sequences derived from SEQ ID NO: 3. As an example of the foregoing, the chimeric RuvC domain comprises amino acids 660 to 823 of SEQ ID NO: 1 and amino acids 921 to 978 of SEQ ID NO: 2. As an alternative example of the foregoing, a chimeric RuvC domain comprises amino acids 647 to 810 of SEQ ID NO: 2 and amino acids 934 to 986 of SEQ ID NO: 1. In some embodiments, the at least one chimeric domain comprises a chimeric helical I domain wherein the chimeric helical I domain comprises amino acids 56-99 of SEQ ID NO: 1 and amino acids 192-332 of SEQ ID NO: 2. In some embodiments, the chimeric CasX variant is further modified, including the CasX variants selected from the group consisting of the sequences of SEQ ID NO: 270, SEQ ID NO: 328, SEQ ID NO: 336, SEQ ID NO: 780, SEQ ID NO: 412, SEQ ID NO: 413, SEQ ID NO: 414, SEQ ID NO: 416, SEQ ID NO: 435, SEQ ID NO: 329, SEQ ID NO: 781, SEQ ID NO: 330, SEQ ID NO: 782, SEQ ID NO: 331, SEQ ID NO: 783, SEQ ID NO: 332, SEQ ID NO: 784, SEQ ID NO: 333, SEQ ID NO: 785, SEQ ID NO: 334, SEQ ID NO: 786, SEQ ID NO: 335, SEQ ID NO: 567, SEQ ID NO: 570, SEQ ID NO: 574, SEQ ID NO: 787, and SEQ ID NO: 788. In some embodiments, the one or more additional modifications comprises an insertion, substitution or deletion as described herein.

In the case of split or non-contiguous domains such as helical I, RuvC and OBD, a portion of the non-contiguous domain can be replaced with the corresponding portion from any other source. For example, the helical I-I domain (sometimes referred to as helical I-a) in SEQ ID NO: 2 can be replaced with the corresponding helical I-I sequence from SEQ ID NO: 1, and the like. Domain sequences from reference CasX proteins, and their coordinates, are shown in Table 4. Representative examples of chimeric CasX proteins include the variants of CasX 472-483, 485-491 and 515, the sequences of which are set forth in Table 3.

TABLE 4

Domain coordinates in Reference CasX proteins

| Domain Name | Coordinates in SEQ ID NO: 1 | Coordinates in SEQ ID NO: 2 |
|---|---|---|
| OBD-I | 1-55 | 1-57 |
| helical I-I | 56-99 | 58-101 |
| NTSB | 100-190 | 102-191 |
| helical I-II | 191-331 | 192-332 |
| helical II | 332-508 | 333-500 |
| OBD-II | 509-659 | 501-646 |
| RuvC-I | 660-823 | 647-810 |
| TSL | 824-933 | 811-920 |
| RuvC-II | 934-986 | 921-978 |

*OBD I and II, helical I-I and I-II, and RuvC I and II are also referred to herein as OBD a and b, helical I a and b, and RuvC a and b.

Exemplary domain sequences are provided in Table 5 below.

TABLE 5

Exemplary Domain Sequences

| SEQ ID | Domain | Sequence |
|---|---|---|
| | *Deltaproteobacter* sp. (reference CasX of SEQ ID NO: 1) | |
| 2333 | OBD-I | EKRINKIRKKLSADNATKPVSRSGPMKTLLVRVMTDDLKKRLEKRRKKPEVMPQ |
| 2334 | helical I-I | VISNNAANNLRMLLDDYTKMKEAILQVYWQEFKDDHVGLMCKFA |
| 2335 | NTSB | QPASKKIDQNKLKPEMDEKGNLTTAGFACSQCGQPLFVYKLEQVSEKGKAYTNY FGRCNVAEHEKLILLAQLKPEKDSDEAVTYSLGKFGQ |
| 2336 | helical I-II | RALDFYSIHVTKESTHPVKPLAQIAGNRYASGPVGKALSDACMGTIASFLSKYQD IIIEHQKVVKGNQKRLESLRELAGKENLEYPSVTLPPQPHTKEGVDAYNEVIARVR MWVNLNLWQ KLKLSRDDAKPLLRLKGFPSF |
| 2337 | helical II | PVVERRENEVDWWNTINEVKKLIDAKRDMGRVFWSGVTAEKRNTILEGYNYLP NENDHKKREGSLENPKKPAKRQFGDLLLYLEKKYAGDWGKVFDEAWERIDKKI AGLTSHIEREEARNAEDAQSKAVLTDWLRAKASFVLERLKEMDEKEFYACEIQL QKWYGDLRG NPFAVEAE |
| 2338 | OBD-II | NRVVDISGFSIGSDGHSIQYRNLLAWKYLENGKREFYLLMNYGKKGRIRFTDGTD IKKSGKWQGLLYGGGKAKVIDLTFDPDDEQLIILPLAFGTRQGREFIWNDLLSLET GLIKLANGRVIEKTIYNKKIG RDEPALFVALTFERREVVD |
| 2339 | RuvC-I | PSNIKPVNLIGVDRGENIPAVIALTDPEGCPLPEFKDSSGGPTDILRIGEGYKEKQR AIQAAKEVEQRRAGGYSRKFASKSRNLADDMVRNSARDLFYHAVTHDAVLVFE NLSRGFGRQGKRTFMTERQYTKMEDWLTAKLAYEGLTSKTYLSKTLAQYTSKT C |
| 2340 | TSL | SNCGFTITTADYDGMLVRLKKTSDGWATTLNNKELKAEGQITYYNRYKRQTVE KELSAELDRLSEESGNNDISKWTKGRRDEALFLLKKRFSHRPVQEQFVCLDCGHE VH |
| 2341 | RuvC-II | ADEQAALNIARSWLFLN SNSTEFKSYKSGKQPFVGAWQAFYKRRLKEVWKPNA |
| | *Planctomycetes* sp. (Reference CasX of SEQ ID NO: 2) | |
| 2342 | OBD-I | QEIKRINKIRRRLVKDSNTKKAGKTGPMKTLLVRVMTPDLRERLENLRKKPENIP Q |
| 2343 | helical I-II | PISNTSRANLNKLLTDYTEMKKAILHVYWEEFQKDPVGLMSRVA |
| 2344 | NTSB | QPAPKNIDQRKLIPVKDGNERLTSSGFACSQCCQPLYVYKLEQVNDKGKPHTNYF GRCNVSEHERLILLSPHKPEANDELVTYSLGKFGQ |
| 2345 | helical I-II | RALDFYSIHVTRESNHPVKPLEQIGGNSCASGPVGKALSDACMGAVASFLTKYQ DIILEHQKVIKKNEKRLANLKDIASANGLAFPKITLPPQPHTKEGIEAYNNVVAQI VIWVNLNLWQKLKIGRDEAKPLQRLKGFPSF |
| 2346 | helical II | PLVERQANEVDWWDMVCNVKKLINEKKEDGKVFWQNLAGYKRQEALLPYLSS EEDRKKGKKFARYQFGDLLLHLEKKHGEDWGKVYDEAWERIDKKVEGLSKHIK LEEERRSEDAQSKAALTDWLRAKASFVIEGLKEADKDEFCRCELKLQKWYGDLR GKPFAIEAE |

TABLE 5-continued

Exemplary Domain Sequences

| SEQ ID | Domain | Sequence |
|---|---|---|
| 2347 | OBD-II | NSILDISGFSKQYNCAFIWQKDGVKKLNLYLIINYFKGGKLRFKKIKPEAFEANRF YTVINKKSGEIVPMEVNFNFDDPNLIILPLAFGKRQGREFIWNDLLSLETGSLK LANGRVIEKTLYNRRTRQDEPALFVALTFERREVLD |
| 2348 | RuvC-I | SSNIKPMNLIGIDRGENIPAVIALTDPEGCPLSRFKDSLGNPTHILRIGESYKEKQRT IQAAKEVEQRRAGGYSRKYASKAKNLADDMVRNTARDLLYYAVTQDAMLIFEN LSRGFGRQGKRTFMAERQYTRMEDWLTAKLAYEGLPSKTYLSKTLAQYTSKTC |
| 2349 | TSL | SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFET H |
| 2350 | RuvC-II | ADEQAALNIARSWLFLRSQEYKKYQTNKTTGNTDKRAFVETWQSFYRKKLKEV WKPAV |

A further exemplary helical II domain sequence is provided as SEQ ID NO: 2351, and a further exemplary RuvC a domain sequence is provided as SEQ ID NO: 2352.

In other embodiments, a CasX variant protein comprises a sequence of SEQ ID NOS: 247-592 or 1147-1231 as set forth in Table 3, and further comprises one or more NLS disclosed herein at or near either the N-terminus, the C-terminus, or both. In other embodiments, a CasX variant protein comprises a sequence of SEQ ID NOS: 270-592 and 1147-1231, and further comprises one or more NLS disclosed herein at or near either the N-terminus, the C-terminus, or both. In other embodiments, a CasX variant protein comprises a sequence of SEQ ID NOS: 415-592 and 1147-1231, and further comprises one or more NLS disclosed herein at or near either the N-terminus, the C-terminus, or both. It will be understood that in some cases, the N-terminal methionine of the CasX variants of the Tables is removed from the expressed CasX variant during post-translational modification. The person of ordinary skill in the art will understand that an NLS near the N or C terminus of a protein can be within 1, 2, 3, 4, 5, 6, 7, 8, 9, 10, 11, 12, 13, 14, 15, 16, 17, 18, 20 or 20 amino acids of the N or C terminus.

f. CasX Variants Derived from Other CasX Variants

In further iterations of the generation of variant proteins, a variant protein can be utilized to generate additional CasX variants of the disclosure. For example, and as illustrated in FIG. 44, CasX 119 (SEQ ID NO: 270), CasX 491 (SEQ ID NO: 336), and CasX 515 (SEQ ID NO: 416) are exemplary variant proteins that are modified to generate additional CasX variants of the disclosure having improvements or additional properties relative to a reference CasX or CasX variants from which they were derived. CasX 119 contains a substitution of L379R, a substitution of A708K and a deletion of P at position 793 of SEQ ID NO: 2. CasX 491 contains NTSB and Helical 1B swap from SEQ ID NO: 1. CasX 515 was derived from CasX 491 by insertion of P at position 793 (relative to SEQ ID NO:2) and was used to create the CasX variants described in Examples 13 and 14. For example, CasX 668 has an insertion of R at position 26 and a substitution of G223S relative to CasX 515. CasX 672 has substitutions of L169K and G223S relative to CasX 515. CasX 676 has substitutions of L169K and G223S and an insertion of R at position 26 relative to CasX 515.

Exemplary methods used to generate and evaluate CasX variants derived from other CasX variants are described in the Examples, which were created by introducing modifications to the encoding sequence resulting in amino acid substitutions, deletions, or insertions at one or more positions in one or more domains of the CasX variant. In particular, Example 14 and Example 15 describe the methods used to create variants of CasX 515 (SEQ ID NO: 416) that were then assayed to determine those positions in the sequence that, when modified by an amino acid insertion, deletion or substitution, resulted in an enrichment or improvement in the assays. In some cases, the results of the assays were used to generate the heat maps of FIGS. 34-36, which provide qualitative and quantitative data at a given amino acid position modified by the methods. For purposes of the disclosure, the sequences of the domains of CasX 515 are provided in Table 4 and include an OBD-I domain having the sequence of SEQ ID NO: 2342, an OBD-II domain having the sequence of SEQ ID NO: 2347, NTSB domain having the sequence of SEQ ID NO: 2335, a helical I-I domain having the sequence of SEQ ID NO: 2343, a helical I-II domain having the sequence of SEQ ID NO: 2336, a helical II domain having the sequence of SEQ ID NO: 2351, a RuvC-I domain having the sequence of SEQ ID NO: 2352, a RuvC-II domain having the sequence of SEQ ID NO: 2350, and a TSL domain having the sequence of SEQ ID NO: 2349. By the methods of the disclosure, individual positions in the domains of CasX 515 were modified, assayed, and the resulting positions and exemplary modifications leading to an enrichment or improvement that follow are provided, relative to their position in each domain or subdomain. In some cases, such positions are disclosed in Tables 21-24 of the Examples. In some embodiments, the disclosure provides CasX variants derived from CasX 515 comprising one or more modifications (i.e., an insertion, a deletion, or a substitution) at one or more amino acid positions in the NTSB domain relative to SEQ ID NO: 2335 selected from the group consisting of P2, S4, Q9, E15, G20, G33, L41, Y51, F55, L68, A70, E75, K88, and G90, wherein the modification results in an improved characteristic relative to CasX 515. In a particular embodiment, the one or more modifications at one or more amino acid positions in the NTSB domain relative to SEQ ID NO: 2335 are selected from the group consisting of ˆG2, ˆI4, ˆL4, Q9P, E15S, G20D, [S30], G33T, L41A, Y51T, F55V, L68D, L68E, L68K, A70Y, A70S, E75A, E75D, E75P, K88Q, and G90Q (where "ˆ" represents and insertion and "[ ]" represents a deletion at that position). In some embodiments, the disclosure provides CasX variants derived from CasX 515 comprising one or more modifications at one or more amino acid positions in the helical I-II domain relative to SEQ ID NO:

2336 selected from the group consisting of I24, A25, Y29 G32, G44, S48, S51, Q54, I56, V63, S73, L74, K97, V100, M112, L116, G137, F138, and S140, wherein the modification results in an improved characteristic relative to CasX 515. In a particular embodiment, the one or more modifications at one or more amino acid positions in the helical I-II domain are selected from the group consisting of ^T24, ^C25, Y29F, G32Y, G32N, G32H, G32S, G32T, G32A, G32V, [G32], G32S, G32T, G44L, G44H, S48H, S48T, S51T, Q54H, I56T, V63T, S73H, L74Y, K97G, K97S, K97D, K97E, V100L, M112T, M112W, M112R, M112K, L116K, G137R, G137K, G137N, ^Q138, and S140Q. In some embodiments, the disclosure provides CasX variants derived from CasX 515 comprising one or more modifications at one or more amino acid positions in the helical II domain relative to SEQ ID NO: 2351 selected from the group consisting of L2, V3, E4, R5, Q6, A7, E9, V10, D11, W12, W13, D14, M15, V16, C17, N18, V19, K20, L22, I23, E25, K26, K31, Q35, L37, A38, K41, R42, Q43, E44, L46, K57, Y65, G68, L70, L71, L72, E75, G79, D81, W82, K84, V85, Y86, D87, I93, K95, K96, E98, L100, K102, I104, K105, E109, R110, D114, K118, A120, L121, W124, L125, R126, A127, A129, I133, E134, G135, L136, E138, D140, K141, D142, E143, F144, C145, C147, E148, L149, K150, L151, Q152, K153, L158, E166, and A167, wherein the modification results in an improved characteristic relative to CasX 515. In a particular embodiment, the one or more modifications at one or more amino acid positions in the helical II domain are selected from the group consisting of ^A2, ^H2, [L2]+[V3], V3E, V3Q, V3F, [V3], ^D3, V3P, E4P, [E4], E4D, E4L, E4R, R5N, Q6V, ^Q6, ^G7, ^H9, ^A9, VD10, ^T10, [V10], ^F10, ^D11, [D11], D11S, [W12], W12T, W12H, ^P12, ^Q13, ^G12, ^R13, W13P, W13D, ^D13, W13L, ^P14, ^D14, [D14]+[M15], [M15], ^T16, ^P17, N18I, V19N, V19H, K20D, L22D, I23S, E25C, E25P, ^G25, K26T, K27E, K31L, K31Y, Q35D, Q35P, A537, [L37]+ [A38], K41L, ^R42, [Q43]+[E44], L46N, K57Q, Y65T, G68M, L70V, L71C, L72D, L72N, L72W, L72Y, E75F, E75L, E75Y, G79P, ^E79, ^T81, ^R81, ^W81, ^Y81, ^W82, ^Y82, W82G, W82R, K84D, K84H, K84P, K84T, V85L, V85A, ^L85, Y86C, D87G, D87M, D87P, I93C, K95T, K96R, E98G, L100A, K102H, I104T, I104S, I104Q, K105D, AK109, E109L, R110D, [R110], D114E, ^D114, K118P, A120R, L121T, W124L, L125C, R126D, A127E, A127L, A129T, A129K, I133E, ^C133, ^S134, ^G134, ^R135, G135P, L136K, L136D, L136S, L136H, [E138], D140R, ^D140, ^P141, ^D142, [E143]+[F144], ^Q143, F144K, [F144], [F144]+[C145], C145R, ^G145, C145K, C147D, ^V148, E148D, ^H149, L149R, K150R, L151H, Q152C, K153P, L158S, E166L, and ^F167. In some embodiments, the disclosure provides CasX variants derived from CasX 515 comprising one or more modifications at one or more amino acid positions in the RuvC-I domain relative to SEQ ID NO: 2352 selected from the group consisting of I4, K5, P6, M7, N8, L9, V12, G49, K63, K80, N83, R90, M125, and L146, wherein the modification results in an improved characteristic relative to CasX 515. In a particular embodiment, the one or more modifications at one or more amino acid positions in the RuvC-I domain are selected from the group consisting of ^I4, ^S5, ^T6, ^N6, ^R7, ^K7, ^H8, ^S8, V12L, G49W, G49R, S51R, S51K, K62S, K62T, K62E, V65A, K80E, N83G, R90H, R90G, M125S, M125A, L137Y, ^P137, [L141], L141R, L141D, ^Q142, ^R143, ^N143, E144N, ^P146, L146F, P147A, K149Q, T150V, ^R152, ^H153, T155Q, ^H155, ^R155, ^L156, [L156], ^W156, ^A157, ^F157, A157S, Q158K, [Y159], T160Y, T160F, ^I161, S161P, T163P, ^N163, C164K, and C164M. In some embodiments, the disclosure provides CasX variants derived from CasX 515 comprising one or more modifications at one or more amino acid positions in the OBD-I domain relative to SEQ ID NO: 2342 selected from the group consisting of I4, K5, P6, M7, N8, L9, V12, G49, K63, K80, N83, R90, M125, and L146, wherein the modification results in an improved characteristic relative to CasX 515. In a particular embodiment, the one or more modifications at one or more amino acid positions in the OBD-I domain are selected from the group consisting of ^G3, I3G, I3E, ^G4, K4G, K4P, K4S, K4W, K4W, R5P, ^P5, ^G5, RSS, ^S5, R5A, R5P, R5G, R5L, I6A, I6L, ^G6, N7Q, N7L, N7S, K8G, K15F, D16W, ^F16, ^F18, ^P27, M28P, M28H, V33T, R34P, M36Y, R41P, L47P, ^P48, E52P, ^P55, [P55]+[Q56], Q56S, Q56P, ^D56, ^T56, and Q56P. In some embodiments, the disclosure provides CasX variants derived from CasX 515 comprising one or more modifications at one or more amino acid positions in the OBD-II domain relative to SEQ ID NO: 2347 selected from the group consisting of I4, K5, P6, M7, N8, L9, V12, G49, K63, K80, N83, R90, M125, and L146, wherein the modification results in an improved characteristic relative to CasX 515. In a particular embodiment, the one or more modifications at one or more amino acid positions in the OBD-I domain are selected from the group consisting of [S2], I3R, I3K, [I3]+[L4], [L4], K11T, ^P24, K37G, R42E, ^S53, ^R58, [K63], M70T, I82T, Q92I, Q92F, Q92V, Q92A, ^A93, K110Q, R115Q, L121T, ^A124, ^R141, ^D143, ^A143, ^W144, and ^A145. In some embodiments, the disclosure provides CasX variants derived from CasX 515 comprising one or more modifications at one or more amino acid positions in the TSL domain relative to SEQ ID NO: 2349 selected from the group consisting of S1, N2, C3, G4, F5, I7, K18, V58, S67, T76, G78, S80, G81, E82, S85, V96, and E98, wherein the modification results in an improved characteristic relative to CasX 515. In a particular embodiment, the one or more modifications at one or more amino acid positions in the OBD-I domain are selected from the group consisting of ^M1, [N2], ^V2, C3S, ^G4, ^W4, F5P, ^W7, K18G, V58D, ^A67, T76E, T76D, T76N, G78D, [S80], [G81], ^E82, ^N82, S85I, V96C, V96T, and E98D. It will be understood that combinations of any of the same foregoing modifications of the paragraph can similarly be introduced into the CasX variants of the disclosure, resulting in a CasX variant with improved characteristics. For example, in one embodiment, the disclosure provides CasX variant 535 (SEQ ID NO: 435), which has a single mutation of G223S relative to CasX 515. In another embodiment, the disclosure provides CasX variant 668 (SEQ ID NO: 567), which has an insertion of R at position 26 and a substitution of G223S relative to CasX 515. In another embodiment, the disclosure provides CasX 672 (SEQ ID NO:570), which has substitutions of L169K and G223S relative to CasX 515. In another embodiment, the disclosure provides CasX 676 (SEQ ID NO: 574), which has substitutions of L169K and G223S and an insertion of R at position 26 relative to CasX 515. CasX variants with improved characteristics relative to CasX 515 include variants of Table 3.

Exemplary characteristics that can be improved in CasX variant proteins relative to the same characteristics in reference CasX proteins or relative to the CasX variant from which they were derived include, but are not limited to improved folding of the variant, increased binding affinity to the gRNA, increased binding affinity to the target nucleic acid, improved ability to utilize a greater spectrum of PAM sequences in the editing and/or binding of target nucleic acid, improved unwinding of the target DNA, increased editing activity, improved editing efficiency, improved editing specificity for the target nucleic acid, decreased off-target editing or cleavage, increased percentage of a eukaryotic genome that can be efficiently edited, increased activity of the nuclease, increased target strand loading for double strand cleavage, decreased target strand loading for single strand nicking, increased binding of the non-target strand of DNA, improved protein stability, improved protein:gRNA (RNP) complex stability, and improved fusion characteristics. In a particular embodiment, as described in the Examples, such improved characterisitics can include, but are not limited to, improved cleavage activity in target nucleic acids having TTC, ATC, and CTC PAM sequences, increased specificity for cleavage of a target nucleic acid sequence, and decreased off-target cleavage of a target nucleic acid.

80%, at least 85%, at least 90% or at least 95%. These improved characteristics are described in more detail, below.

g. Protein Stability

In some embodiments, the disclosure provides a CasX variant protein with improved stability relative to a reference CasX protein. In some embodiments, improved stability of the CasX variant protein results in expression of a higher steady state of protein, which improves editing efficiency. In some embodiments, improved stability of the CasX variant protein results in a larger fraction of CasX protein that remains folded in a functional conformation and improves editing efficiency or improves purifiability for manufacturing purposes. As used herein, a "functional conformation" refers to a CasX protein that is in a conformation where the protein is capable of binding a gRNA and target nucleic acid.

TABLE 6

CasX 515 domain sequences

| Domain | SEQ ID NO | Amino Acid Sequence |
|---|---|---|
| ODB-I | 2342 | QEIKRINKIRRRLVKDSNTKKAGKTGPMKTLLVRVMTPDLRERLE NLRKKPENIPQ |
| Helical I-I | 2343 | PISNTSRANLNKLLTDYTEMKKAILHVYWEEFQKDPVGLMSRVA |
| NTSB | 2335 | QPASKKIDQNKLKPEMDEKGNLTTAGFACSQCGQPLFVYKLEQV SEKGKAYTNYFGRCNVAEHEKLILLAQLKPEKDSDEAVTYSLGKF GQ |
| Helical I-II | 2336 | RALDFYSIHVTKESTHPVKPLAQIAGNRYASGPVGKALSDACMGT IASFLSKYQDIIIEHQKVVKGNQKRLESLRELAGKENLEYPSVTLPP QPHTKEGVDAYNEVIARVRMWVNLNLWQKLKLSRDDAKPLLRL KGFPSF |
| Helical II | 2351 | PLVERQANEVDWWDMVCNVKKLINEKKEDGKVFWQNLAGYKR QEALRPYLSSEEDRKKGKKFARYQLGDLLLHLEKKHGEDWGKV YDEAWERIDKKVEGLSKHIKLEEERRSEDAQSKAALTDWLRAKA SFVIEGLKEADKDEFCRCELKLQKWYGDLRGKPFAIEAE |
| OBD-II | 2347 | NSILDISGFSKQYNCAFIWQKDGVKKLNLYLIINYFKGGKLRFKKI KPEAFEANRFYTVINKKSGEIVPMEVNFNFDDPNLIILPLAFGKRQ GREFIWNDLLSLETGSLKLANGRVIEKTLYNRRTRQDEPALFVAL TFERREVLD |
| RuvC-I | 2352 | SSNIKPMNLIGVDRGENIPAVIALTDPEGCPLSRFKDSLGNPTHILRI GESYKEKQRTIQAKKEVEQRRAGGYSRKYASKAKNLADDMVRN TARDLLYYAVTQDAMLIFENLSRGFGRQGKRTFMAERQYTRMED WLTAKLAYEGLPSKTYLSKTLAQYTSKTC |
| TSL | 2349 | SNCGFTITSADYDRVLEKLKKTATGWMTTINGKELKVEGQITYYN RYKRQNVVKDLSVELDRLSEESVNNDISSWTKGRSGEALSLLKKR FSHRPVQEKFVCLNCGFETH |
| RuvC-II | 2350 | ADEQAALNIARSWLFLRSQEYKKYQTNKTTGNTDKRAFVETWQS FYRKKLKEVWKPAV |

The CasX variants of the embodiments described herein have the ability to form an RNP complex with the gRNA disclosed herein. In some embodiments, an RNP comprising the CasX variant protein and a gRNA of the disclosure, at a concentration of 20 pM or less, is capable of cleaving a double stranded DNA target with an efficiency of at least 80%. In some embodiments, the RNP at a concentration of 20 pM or less is capable of cleaving a double stranded DNA target with an efficiency of at least 40%, at least 50%, at least 60%, at least 70%, at least 80%, at least 85%, at least 90% or at least 95%. In some embodiments, the RNP at a concentration of 50 pM or less, 40 pM or less, 30 pM or less, 20 pM or less, 10 pM or less, or 5 pM or less, is capable of cleaving a double stranded DNA target with an efficiency of at least 40%, at least 50%, at least 60%, at least 70%, at least In embodiments wherein the CasX variant does not carry one or more mutations rendering it catalytically-dead, the CasX variant is capable of cleaving, nicking, or otherwise modifying the target nucleic acid when complexed with the gRNA with a targeting sequence capable of hybridizing with the target nucleic acid. A functional conformation of a CasX refers to an "cleavagecompetent" conformation. In some exemplary embodiments, including those embodiments where the CasX variant protein results in a larger fraction of CasX protein that remains folded in a functional conformation, a lower concentration of CasX variant is needed for applications such as gene editing compared to a reference CasX protein. Thus, in some embodiments, the CasX variant with improved stability has improved efficiency compared to a reference CasX in one or more gene editing contexts.

In some embodiments, the disclosure provides a CasX variant protein having improved stability of the CasX variant protein:gRNA RNP complex relative to the reference CasX protein:gRNA complex such that the RNP remains in a functional form. Stability improvements can include increased thermostability, resistance to proteolytic degradation, enhanced pharmacokinetic properties, stability across a range of pH conditions, salt conditions, and tonicity. Improved stability of the complex may, in some embodiments, lead to improved editing efficiency. In some embodiments, the RNP of the CasX variant and gRNA variant has at least a 2-fold, at least a 3-fold, or at least a 4-fold higher percentage of cleavage-competent RNP compared to an RNP of the reference CasX of SEQ ID NOS: 1-3 and the gRNA of SEQ ID NOS:4 or 5 of Table 1. Exemplary data of increased cleavage-competent RNP are provided in the Examples.

In some embodiments, improved stability of the CasX variant protein comprises improved folding kinetics of the CasX variant protein relative to a reference CasX protein. In some embodiments, folding kinetics of the CasX variant protein are improved relative to a reference CasX protein by at least about 5, at least about 10, at least about 50, at least about 100, at least about 500, at least about 1,000, at least about 2,000, at least about 3,000, at least about 4,000, at least about 5,000, or at least about a 10,000-fold improvement. In some embodiments, folding kinetics of the CasX variant protein are improved relative to a reference CasX protein by at least about 1 kJ/mol, at least about 5 kJ/mol, at least about 10 kJ/mol, at least about 20 kJ/mol, at least about 30 kJ/mol, at least about 40 kJ/mol, at least about 50 kJ/mol, at least about 60 kJ/mol, at least about 70 kJ/mol, at least about 80 kJ/mol, at least about 90 kJ/mol, at least about 100 kJ/mol, at least about 150 kJ/mol, at least about 200 kJ/mol, at least about 250 kJ/mol, at least about 300 kJ/mol, at least about 350 kJ/mol, at least about 400 kJ/mol, at least about 450 kJ/mol, or at least about 500 kJ/mol.

Exemplary amino acid changes that can increase the stability of a CasX variant protein relative to a reference CasX protein may include, but are not limited to, amino acid changes that increase the number of hydrogen bonds within the CasX variant protein, increase the number of disulfide bridges within the CasX variant protein, increase the number of salt bridges within the CasX variant protein, strengthen interactions between parts of the CasX variant protein, increase the buried hydrophobic surface area of the CasX variant protein, or any combinations thereof.

h. Protein Affinity for the gRNA

In some embodiments, a CasX variant protein has improved affinity for the gRNA relative to a reference CasX protein, or to another CasX variant from which it was derived, leading to the formation of the ribonucleoprotein complex. Increased affinity of the CasX variant protein for the gRNA may, for example, result in a lower $K_d$ for the generation of an RNP complex, which can, in some cases, result in a more stable RNP complex formation. In some embodiments, increased affinity of the CasX variant protein for the gRNA results in increased stability of the RNP complex when delivered to human cells. This increased stability can affect the function and utility of the complex in the cells of a subject, as well as result in improved pharmacokinetic properties in blood, when delivered to a subject. In some embodiments, increased affinity of the CasX variant protein, and the resulting increased stability of the RNP complex, allows for a lower dose of the CasX variant protein to be delivered to the subject or cells while still having the desired activity, for example in vivo or in vitro gene editing.

In some embodiments, a higher affinity (tighter binding) of a CasX variant protein to a gRNA allows for a greater amount of editing events when both the CasX variant protein and the gRNA remain in an RNP complex. Increased editing events can be assessed using editing assays described herein.

In some embodiments, the $K_d$ of a CasX variant protein for a gRNA is increased relative to a reference CasX protein, or to another CasX variant from which it was derived, by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant has about 1.1 to about 10-fold increased binding affinity to the gRNA compared to the reference CasX protein of SEQ ID NO: 2.

Without wishing to be bound by theory, in some embodiments amino acid changes in the helical I domain can increase the binding affinity of the CasX variant protein with the gRNA targeting sequence, while changes in the helical II domain can increase the binding affinity of the CasX variant protein with the gRNA scaffold stem loop, and changes in the oligonucleotide binding domain (OBD) increase the binding affinity of the CasX variant protein with the gRNA triplex.

Methods of measuring CasX protein binding affinity for a gRNA include in vitro methods using purified CasX protein and gRNA. The binding affinity for reference CasX and variant proteins can be measured by fluorescence polarization if the gRNA or CasX protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference CasX and variant proteins of the disclosure for specific gRNAs such as reference gRNAs and variants thereof include, but are not limited to, isothermal calorimetry (ITC), and surface plasmon resonance (SPR), as well as the methods of the Examples.

i. Affinity for Target Nucleic Acid

In some embodiments, a CasX variant protein has increased binding affinity for a target nucleic acid relative to the affinity of a reference CasX protein for a target nucleic acid, or to another CasX variant from which it was derived. CasX variants with higher affinity for their target nucleic acid may, in some embodiments, cleave the target nucleic acid sequence more rapidly than a reference CasX protein that does not have increased affinity for the target nucleic acid.

In some embodiments, the improved affinity for the target nucleic acid comprises improved affinity for the target sequence or protospacer sequence of the target nucleic acid, improved affinity for the PAM sequence, an improved ability to search DNA for the target sequence, or any combinations thereof. Without wishing to be bound by theory, it is thought that CRISPR/Cas system proteins such as CasX may find their target sequences by one-dimension diffusion along a DNA molecule. The process is thought to include (1) binding of the ribonucleoprotein to the DNA molecule followed by (2) stalling at the target sequence, either of which may be, in some embodiments, affected by improved affinity of CasX proteins for a target nucleic acid sequence, thereby improving function of the CasX variant protein compared to a reference CasX protein.

In some embodiments, a CasX variant protein with improved target nucleic acid affinity has increased affinity for or the ability to utilize specific PAM sequences other than the canonical TTC PAM recognized by the reference CasX protein of SEQ ID NO: 2, including PAM sequences selected from the group consisting of TTC, ATC, GTC, and CTC, thereby increasing the amount of target nucleic acid that can be edited compared to wild-type CasX nucleases or the nucleases of CasX 199 or 491. Without wishing to be bound by theory, it is possible that these protein variants may interact more strongly with DNA overall and may have an increased ability to access and edit sequences within the target nucleic acid due to the ability to utilize additional PAM sequences beyond those of wild-type reference CasX or the nucleases of CasX 199 or 491, thereby allowing for a more efficient search process of the CasX protein for the target sequence. A higher overall affinity for DNA also, in some embodiments, can increase the frequency at which a CasX protein can effectively start and finish a binding and unwinding step, thereby facilitating target strand invasion and R-loop formation, and ultimately the cleavage of a target nucleic acid sequence.

Without wishing to be bound by theory, it is possible that amino acid changes in the NTSB domain that increase the efficiency of unwinding, or capture, of a non-target nucleic acid strand in the unwound state, can increase the affinity of CasX variant proteins for target nucleic acid. Alternatively, or in addition, amino acid changes in the NTSB domain that increase the ability of the NTSB domain to stabilize DNA during unwinding can increase the affinity of CasX variant proteins for target nucleic acid. Alternatively, or in addition, amino acid changes in the OBD may increase the affinity of CasX variant protein binding to the protospacer adjacent motif (PAM), thereby increasing affinity of the CasX variant protein for target nucleic acid. Alternatively, or in addition, amino acid changes in the Helical I and/or II, RuvC and TSL domains that increase the affinity of the CasX variant protein for the target nucleic acid strand can increase the affinity of the CasX variant protein for target nucleic acid.

In some embodiments, binding affinity of a CasX variant protein of the disclosure for a target nucleic acid molecule is increased relative to a reference CasX protein, or to another CasX variant from which it was derived, by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant protein has about 1.1 to about 100-fold increased binding affinity to the target nucleic acid compared to the reference protein of SEQ ID NO: 1, SEQ ID NO: 2, or SEQ ID NO: 3, or to the CasX 491 and 515 variants.

In some embodiments, a CasX variant protein has increased binding affinity for the non-target strand of the target nucleic acid. As used herein, the term "non-target strand" refers to the strand of the DNA target nucleic acid sequence that does not form Watson and Crick base pairs with the targeting sequence in the gRNA, and is complementary to the target nucleic acid strand. In some embodiments, the CasX variant protein has about 1.1 to about 100-fold increased binding affinity to the non-target stand of the target nucleic acid compared to the reference protein of SEQ ID NO: 1, SEQ ID NO: 2, or SEQ ID NO: 3, or to the CasX variants of SEQ ID NO: 270, or SEQ ID NO: 336.

Methods of measuring CasX protein (such as reference or variant) affinity for a target and/or non-target nucleic acid molecule may include electrophoretic mobility shift assays (EMSAs), filter binding, isothermal calorimetry (ITC), and surface plasmon resonance (SPR), fluorescence polarization and biolayer interferometry (BLI). Further methods of measuring CasX protein affinity for a target include in vitro biochemical assays that measure DNA cleavage events over time.

j. Improved Specificity for a Target Site

In some embodiments, a CasX variant protein has improved specificity for a target nucleic acid sequence relative to a reference CasX protein, or to another CasX variant from which it was derived. As used herein, "specificity," sometimes referred to as "target specificity," refers to the degree to which a CRISPR/Cas system ribonucleoprotein complex cleaves off-target sequences that are similar, but not identical to the target nucleic acid sequence; e.g., a CasX variant RNP with a higher degree of specificity would exhibit reduced off-target cleavage of sequences relative to a reference CasX protein. The specificity, and the reduction of potentially deleterious off-target effects, of CRISPR/Cas system proteins can be vitally important in order to achieve an acceptable therapeutic index for use in mammalian subjects.

In some embodiments, a CasX variant protein has improved specificity for a target site within the target sequence that is complementary to the targeting sequence of the gRNA. As described, supra, correlate to improved specificity is reduced off-target editing. In some embodiments, a CasX variant protein exhibits reduced off-target editing or cleavage for a target site within the target sequence that is not 100% complementary to the targeting sequence of the gRNA complexed with the CasX variant as an RNP. Without wishing to be bound by theory, it is possible that amino acid changes in the helical I and II domains that increase the specificity of the CasX variant protein for the target nucleic acid strand can increase the specificity of the CasX variant protein for the target nucleic acid overall. In some embodiments, amino acid changes that increase specificity of CasX variant proteins for target nucleic acid may also result in decreased affinity of CasX variant proteins for DNA.

Methods of testing CasX protein (such as variant or reference) target specificity may include guide and Circularization for In vitro Reporting of Cleavage Effects by Sequencing (CIRCLE-seq), or similar methods. In brief, in CIRCLE-seq techniques, genomic DNA is sheared and circularized by ligation of stem-loop adapters, which are nicked in the stem-loop regions to expose 4 nucleotide palindromic overhangs. This is followed by intramolecular ligation and degradation of remaining linear DNA. Circular DNA molecules containing a CasX cleavage site are subsequently linearized with CasX, and adapter adapters are ligated to the exposed ends followed by high-throughput sequencing to generate paired end reads that contain information about the off-target site. Additional assays that can be used to detect off-target events, and therefore CasX protein specificity include assays used to detect and quantify indels (insertions and deletions) formed at those selected off-target sites such as mismatch-detection nuclease assays and next generation sequencing (NGS). Exemplary mismatch-detection assays include nuclease assays, in which genomic DNA from cells treated with CasX and sgRNA is PCR amplified, denatured and rehybridized to form hetero-duplex DNA, containing one wild-type strand and one strand with an indel. Mismatches are recognized and cleaved by mismatch detection nucleases, such as Surveyor nuclease or T7 endonuclease I. Methods to evaluate the specificity of the CasX variants, along with supporting data demonstrating improved specificity of embodiments of CasX variants, are described in the Examples.

k. Protospacer and PAM Sequences

Herein, the protospacer is defined as the DNA sequence complementary to the targeting sequence of the guide RNA and the DNA complementary to that sequence, referred to as the target strand and non-target strand, respectively. As used herein, the PAM is a nucleotide sequence proximal to the protospacer that, in conjunction with the targeting sequence of the gRNA, helps the orientation and positioning of the CasX for the potential cleavage of the protospacer strand(s).

PAM sequences may be degenerate, and specific RNP constructs may have different preferred and tolerated PAM sequences that support different efficiencies of cleavage. Following convention, unless stated otherwise, the disclosure refers to both the PAM and the protospacer sequence and their directionality according to the orientation of the non-target strand. This does not imply that the PAM sequence of the non-target strand, rather than the target strand, is determinative of cleavage or mechanistically involved in target recognition. For example, when reference is to a TTC PAM, it may in fact be the complementary GAA sequence that is required for target cleavage, or it may be some combination of nucleotides from both strands. In the case of the CasX proteins disclosed herein, the PAM is located 5' of the protospacer with a single nucleotide separating the PAM from the first nucleotide of the protospacer. Thus, in the case of reference CasX, a TTC PAM should be understood to mean a sequence following the formula 5'- . . . NNTTCN(protospacer)NNNNNN . . . 3' (SEQ ID NO: 19) where 'N' is any DNA nucleotide and '(protospacer)' is a DNA sequence having identity with the targeting sequence of the guide RNA. In the case of a CasX variant with expanded PAM recognition, a TTC, CTC, GTC, or ATC PAM should be understood to mean a sequence following the formulae: 5'- . . . NNTTCN(protospacer) NNNNNN . . . 3' (SEQ ID NO: 19); 5'- . . . NNCTC (protospacer)NNNNNN . . . 3' (SEQ ID NO: 20); 5'- . . . NNGTCN(protospacer)NNNNNN . . . 3' (SEQ ID NO: 21); or 5'- . . . NNATCN(protospacer)NNNNNN . . . 3' (SEQ ID NO: 22). Alternatively, a TC PAM should be understood to mean a sequence following the formula 5'- . . . NNNTCN (protospacer)NNNNNN . . . 3' (SEQ ID NO: 23).

Additionally, the CasX variant proteins of the disclosure have an enhanced ability to efficiently edit and/or bind target nucleic acid, when complexed with a gRNA as an RNP, utilizing a PAM TC motif, including PAM sequences selected from TTC, ATC, GTC, or CTC, (in a 5' to 3' orientation), compared to an RNP of a reference CasX protein and reference gRNA, or to an RNP of another CasX variant from which it was derived, such as CasX 491, and gRNA 174. In the foregoing, the PAM sequence is located at least 1 nucleotide 5' to the non-target strand of the protospacer having identity with the targeting sequence of the gRNA in an assay system compared to the editing efficiency and/or binding of an RNP comprising a reference CasX protein and reference gRNA in a comparable assay system. In one embodiment, an RNP of a CasX variant and gRNA variant exhibits greater editing efficiency and/or binding of a target sequence in the target nucleic acid compared to an RNP comprising a reference CasX protein and a reference gRNA (or an RNP of another CasX variant from which it was derived, such as CasX 491, and gRNA 174) in a comparable assay system, wherein the PAM sequence of the target DNA is TTC. In another embodiment, an RNP of a CasX variant and gRNA variant exhibits greater editing efficiency and/or binding of a target sequence in the target nucleic acid compared to an RNP comprising a reference CasX protein and a reference gRNA (or an RNP of another CasX variant from which it was derived, such as CasX 491 and gRNA 174) in a comparable assay system, wherein the PAM sequence of the target DNA is ATC. In a particular embodiment of the foregoing, wherein the CasX variant exhibits enhanced editing with an ATC PAM, the CasX variant is 528 (SEQ ID NO: 428). In another embodiment, an RNP of a CasX variant and gRNA variant exhibits greater editing efficiency and/or binding of a target sequence in the target nucleic acid compared to an RNP comprising a reference CasX protein and a reference gRNA (or an RNP of another CasX variant from which it was derived, such as CasX 491, and gRNA 174) in a comparable assay system, wherein the PAM sequence of the target DNA is CTC. In another embodiment, an RNP of a CasX variant and gRNA variant exhibits greater editing efficiency and/or binding of a target sequence in the target nucleic acid compared to an RNP comprising a reference CasX protein and a reference gRNA (or an RNP of another CasX variant from which it was derived and gRNA 174) in a comparable assay system, wherein the PAM sequence of the target DNA is GTC. In the foregoing embodiments, the increased editing efficiency and/or binding affinity for the one or more PAM sequences is at least 1.5-fold, at least 2-fold, at least 4-fold, at least 10-fold, at least 20-fold, at least 30-fold, or at least 40-fold greater or more compared to the editing efficiency and/or binding affinity of an RNP of any one of the CasX proteins of SEQ ID NOS: 1-3 and the gRNA of Table 1 for the PAM sequences. Exemplary assays demonstrating the improved editing are described herein, in the Examples (see, e.g., FIG. 41). In some embodiments, a CasX protein can bind and/or modify (e.g., cleave, nick, methylate, demethylate, etc.) a target nucleic acid and/or a polypeptide associated with target nucleic acid (e.g., methylation or acetylation of a histone tail). In some embodiments, the CasX protein is catalytically-dead (dCasX) but retains the ability to bind a target nucleic acid.

l. Unwinding of DNA

In some embodiments, a CasX variant protein has improved ability to unwind DNA relative to a reference CasX protein. Poor dsDNA unwinding has been shown previously to impair or prevent the ability of CRISPR/Cas system proteins AnaCas9 or Cas14s to cleave DNA. Therefore, without wishing to be bound by any theory, it is likely that increased DNA cleavage activity by some CasX variant proteins of the disclosure is due, at least in part, to an increased ability to find and unwind the dsDNA at a target site. Methods of measuring the ability of CasX proteins (such as variant or reference) to unwind DNA include, but are not limited to, in vitro assays that observe increased on rates of dsDNA targets in fluorescence polarization or biolayer interferometry.

Without wishing to be bound by theory, it is thought that amino acid changes in the NTSB domain may produce CasX variant proteins with increased DNA unwinding characteristics. Alternatively, or in addition, amino acid changes in the OBD or the helical domain regions that interact with the PAM may also produce CasX variant proteins with increased DNA unwinding characteristics.

Methods of measuring the ability of CasX proteins (such as variant or reference) to unwind DNA include, but are not limited to, in vitro assays that observe increased on rates of dsDNA targets in fluorescence polarization or biolayer interferometry.

m. Catalytic Activity

The ribonucleoprotein complex of the CasX:gRNA systems disclosed herein comprise a CasX variant complexed with a gRNA variant that binds to a target nucleic acid and, in some cases, cleaves the target nucleic acid. In some embodiments, a CasX variant protein has improved catalytic activity relative to a reference CasX protein, or to another CasX variant from which it was derived. Without wishing to be bound by theory, it is thought that in some cases cleavage of the target strand can be a limiting factor for Cas12-like molecules in creating a dsDNA break. In some embodiments, CasX variant proteins improve bending of the target strand of DNA and cleavage of this strand, resulting in an improvement in the overall efficiency of dsDNA cleavage by the CasX ribonucleoprotein complex.

In some embodiments, a CasX variant protein has increased nuclease activity compared to a reference CasX protein, or to another CasX variant from which it was derived. Variants with increased nuclease activity can be generated, for example, through amino acid changes in the RuvC nuclease domain. In some embodiments, the CasX variant comprises a RuvC nuclease domain having nickase activity. In the foregoing, the CasX nickase of a CasX:gRNA system generates a single-stranded break within 10-18 nucleotides 3' of a PAM site in the non-target strand. In other embodiments, the CasX variant comprises a RuvC nuclease domain having double-stranded cleavage activity. In the foregoing, the CasX of the CasX:gRNA system generates a double-stranded break within 18-26 nucleotides 5' of a PAM site on the target strand and 10-18 nucleotides 3' on the non-target strand. Nuclease activity can be assayed by a variety of methods, including those of the Examples. In some embodiments, a CasX variant has a $k_{cleave}$ constant that is at least 2-fold, or at least 3-fold, or at least 4-fold, or at least 5-fold, or at least 6-fold, or at least 7-fold, or at least 8-fold, or at least 9-fold, or at least 10-fold greater compared to a reference CasX.

In some embodiments, a CasX variant protein has the improved characteristic of forming RNP with gRNA that result in a higher percentage of cleavage-competent RNP compared to an RNP of a reference CasX protein of SEQ ID NO: 1, SEQ ID NO: 2, or SEQ ID NO: 3 and the gRNA, as described in the Examples. By cleavage competent, it is meant that the RNP that is formed has the ability to cleave the target nucleic acid. In some embodiments, the RNP of the CasX variant and the gRNA exhibit at least a 2-fold, or at least a 3-fold, or at least a 4-fold, or at least a 5-fold, or at least a 10-fold cleavage rate compared to an RNP of a reference CasX protein of SEQ ID NO: 1, SEQ ID NO: 2, or SEQ ID NO: 3 and the gRNA of Table 2. In the foregoing embodiment, the improved competency rate can be demonstrated in an in vitro assay, such as described in the Examples.

In some embodiments, a CasX variant protein has increased target strand loading for double strand cleavage compared to a reference CasX. Variants with increased target strand loading activity can be generated, for example, through amino acid changes in the TLS domain. Without wishing to be bound by theory, amino acid changes in the TSL domain may result in CasX variant proteins with improved catalytic activity. Alternatively, or in addition, amino acid changes around the binding channel for the RNA:DNA duplex may also improve catalytic activity of the CasX variant protein.

In some embodiments, a CasX variant protein has increased collateral cleavage activity compared to a reference CasX protein. As used herein, "collateral cleavage activity" refers to additional, non-targeted cleavage of nucleic acids following recognition and cleavage of a target nucleic acid sequence. In some embodiments, a CasX variant protein has decreased collateral cleavage activity compared to a reference CasX protein.

Exemplary methods for characterizing the catalytic activity of CasX proteins may include, but are not limited to, in vitro cleavage assays, including those of the Examples, below. In some embodiments, electrophoresis of DNA products on agarose gels can interrogate the kinetics of strand cleavage.

n. Affinity for Target RNA

In some embodiments, a ribonucleoprotein complex comprising a reference CasX protein or variant thereof binds to a target RNA and cleaves the target nucleic acid. In some embodiments, variants of a reference CasX protein increase the specificity of the CasX variant protein for a target RNA and increase the activity of the CasX variant protein with respect to a target RNA when compared to the reference CasX protein. For example, CasX variant proteins can display increased binding affinity for target RNAs, or increased cleavage of target RNAs, when compared to reference CasX proteins. In some embodiments, a ribonucleoprotein complex comprising a CasX variant protein binds to a target RNA and/or cleaves the target RNA. In some embodiments, a CasX variant has at least about two-fold to about 10-fold increased binding affinity to the target nucleic acid compared to the reference protein of SEQ ID NO: 1, SEQ ID NO: 2, or SEQ ID NO: 3, or to the CasX variant of SEQ ID NO: 270, or SEQ ID NO: 336.

o. Catalytically-Dead CasX Variants

In some embodiments, for example those embodiments encompassing applications where cleavage of the target nucleic acid sequence is not a desired outcome, improving the catalytic activity of a CasX variant protein comprises altering, reducing, or abolishing the catalytic activity of the CasX variant protein. In some embodiments, the disclosure provides catalytically-dead CasX variant proteins that, while able to bind a target nucleic acid when complexed with a gRNA having a targeting sequence complementary to the target nucleic acid, are not able to cleave the target nucleic acid. Exemplary catalytically-dead CasX proteins comprise one or more mutations in the active site of the RuvC domain of the CasX protein. In some embodiments, a catalytically-dead CasX variant protein comprises substitutions at residues 672, 769 and/or 935 relative to SEQ ID NO: 1. In one embodiment, a catalytically-dead CasX variant protein comprises substitutions of D672A, E769A and/or D935A relative to a reference CasX protein of SEQ ID NO: 1. In other embodiments, a catalytically-dead CasX variant protein comprises substitutions at amino acids 659, 756 and/or 922 relative to a reference CasX protein of SEQ ID NO: 2. In some embodiments, a catalytically-dead CasX variant protein comprises D659A, E756A and/or D922A substitutions relative to a reference CasX protein of SEQ ID NO: 2. In some embodiments, a catalytically-dead CasX variant 527, 668 and 676 proteins comprise D660A, E757A, and D922A modifications to abolish the endonuclease activity. In further embodiments, a catalytically-dead CasX protein comprises deletions of all or part of the RuvC domain of the CasX protein. It will be understood that the same foregoing substitutions can similarly be introduced into the CasX variants of the disclosure, resulting in a catalytically-dead CasX (dCasX) variant. In one embodiment, all or a portion of the RuvC domain is deleted from the CasX variant, resulting in a dCasX variant. Catalytically inactive dCasX variant proteins can, in some embodiments, be used for base editing with a higher affinity for DNA, in some embodiments, catalytically inactive dCasX variant proteins can, relative to catalytically active CasX, find their target nucleic acid faster, remain bound to target nucleic acid for longer periods of time, bind target nucleic acid in a more stable fashion, or a combination thereof, thereby improving these functions of the catalytically-dead CasX variant protein compared to a CasX variant that retains its cleavage capability. Exemplary dCasX variant sequences are disclosed as SEQ ID NOS: 44-62 and 1232-1235 as set forth in Table 7. In some embodiments, a dCasX variant is at least 80% identical, at least 85% identical, at least 90% identical, at least 95% identical, at least 96% identical, at least 97% identical, at least 98% identical, or at least 99% identical to a sequence of SEQ ID NOS: 44-62 or 1232-1235 and retains the functional properties of a dCasX variant protein. In some embodiments, a dCasX variant comprises a sequence of SEQ ID NOS: 44-62 or 1232-1235.

TABLE 7

Catalytically-dead CasX Variant Proteins

| Construct | SEQ ID NO |
|---|---|
| CAS100 | 44 |
| CAS098 | 45 |
| CAS085 | 46 |
| CAS087 | 47 |
| CAS086 | 48 |
| CAS083 | 49 |
| CAS082 | 50 |
| CAS069 | 51 |
| CAS068 | 52 |
| CAS070 | 53 |
| CAS071 | 54 |
| CAS072 | 55 |
| CAS073 | 56 |
| CAS074 | 57 |
| CAS075 | 58 |
| CAS076 | 59 |
| CAS077 | 60 |
| CAS078 | 61 |
| CAS081 | 62 |
| CAS096 | 1232 |
| CAS401 | 1233 |
| CAS142 (dCasX527) | 1234 |
| CAS402 (dCasX676) | 1235 | p. CasX Fusion Proteins

In some embodiments, the disclosure provides CasX variant proteins comprising a heterologous protein fused to the CasX, including the CasX variant of any of the embodiments described herein. This includes CasX variants comprising N-terminal, C-terminal, or internal fusions of the CasX to a heterologous protein or domain thereof.

In some embodiments, the CasX fusion protein comprises any one of the variants SEQ ID NOS: 247-592 or 1147-1231 or the sequences of Table 3, fused to one or more proteins or domains thereof that have a different activity of interest, resulting in a fusion protein. In some embodiments, the CasX fusion protein comprises any one of the variants SEQ ID NOS: 270-592 or 1147-1231, fused to one or more proteins or domains thereof that have a different activity of interest. In some embodiments, the CasX fusion protein comprises any one of the variants SEQ ID NOS: 415-592 or 1147-1231, fused to one or more proteins or domains thereof that have a different activity of interest. For example, in some embodiments, the CasX variant protein is fused to a protein (or domain thereof) that inhibits transcription, modifies a target nucleic acid, or modifies a polypeptide associated with a nucleic acid (e.g., histone modification).

In some embodiments, a heterologous polypeptide (or heterologous amino acid such as a cysteine residue or a non-natural amino acid) can be inserted at one or more positions within a CasX protein to generate a CasX fusion protein. In other embodiments, a cysteine residue can be inserted at one or more positions within a CasX protein followed by conjugation of a heterologous polypeptide described below. In some alternative embodiments, a heterologous polypeptide or heterologous amino acid can be added at the N- or C-terminus of the reference or CasX variant protein. In other embodiments, a heterologous polypeptide or heterologous amino acid can be inserted internally within the sequence of the CasX protein.

In some embodiments, the CasX variant fusion protein retains RNA-guided sequence specific target nucleic acid binding and cleavage activity. In some cases, the CasX variant fusion protein has (retains) 50% or more of the activity (e.g., cleavage and/or binding activity) of the corresponding CasX variant protein that does not have the insertion of the heterologous protein. In some cases, the CasX variant fusion protein retains at least about 60%, or at least about 70%, at least about 80%, or at least about 90%, or at least about 92%, or at least about 95%, or at least about 98%, or about 100% of the activity (e.g., cleavage and/or binding activity) of the corresponding CasX protein that does not have the insertion of the heterologous protein.

In some cases, the reference CasX or CasX variant fusion protein retains (has) target nucleic acid binding activity relative to the activity of the CasX protein without the inserted heterologous amino acid or heterologous polypeptide. In some cases, the reference CasX or CasX variant fusion protein retains at least about 60%, or at least about 70%, at least about 80%, or at least about 90%, or at least about 92%, or at least about 95%, or at least about 98%, or about 100% of the binding activity of the corresponding CasX protein that does not have the insertion of the heterologous protein.

In some cases, the CasX variant fusion protein retains (has) target nucleic acid binding and/or cleavage activity relative to the activity of the parent CasX protein without the inserted heterologous amino acid or heterologous polypeptide. For example, in some cases, the CasX variant fusion protein has (retains) 50% or more of the binding and/or cleavage activity of the corresponding parent CasX protein (the CasX protein that does not have the insertion). For example, in some cases, the CasX variant fusion protein has (retains) 60% or more (70% or more, 80% or more, 90% or more, 92% or more, 95% or more, 98% or more, or 100%) of the binding and/or cleavage activity of the corresponding CasX parent protein (the CasX protein that does not have the insertion). Methods of measuring cleaving and/or binding activity of a CasX protein and/or a CasX fusion protein will be known to one of ordinary skill in the art, and any convenient method can be used.

A variety of heterologous polypeptides are suitable for inclusion in a CasX variant fusion protein of the disclosure. In some cases, the fusion partner can modulate transcription (e.g., inhibit transcription, increase transcription) of a target nucleic acid. For example, in some cases the fusion partner is a protein (or a domain from a protein) that inhibits transcription (e.g., a transcriptional repressor, a protein that functions via recruitment of transcription inhibitor proteins, modification of target nucleic acid such as methylation, recruitment of a DNA modifier, modulation of histones associated with target nucleic acid, recruitment of a histone modifier such as those that modify acetylation and/or methylation of histones, and the like). In some cases, the fusion partner is a protein (or a domain from a protein) that increases transcription (e.g., a transcription activator, a protein that acts via recruitment of transcription activator proteins, modification of target nucleic acid such as demethylation, recruitment of a DNA modifier, modulation of histones associated with target nucleic acid, recruitment of a histone modifier such as those that modify acetylation and/or methylation of histones, and the like).

In some cases, a fusion partner has enzymatic activity that modifies a target nucleic acid sequence; e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity. In some embodiments, a CasX variant comprises any one of SEQ ID NOS: 247-592 or 1147-1231 and a polypeptide with methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some embodiments, a CasX variant comprises any one of SEQ ID NOS: 270-592 or 1147-1231 and a polypeptide as described supra. In some embodiments, a CasX variant comprises any one of SEQ ID NOS: 415-592 or 1147-1231 and a polypeptide as described supra.

Examples of proteins (or fragments thereof) that can be used as a fusion partner to increase transcription include but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET1A, SET1B, MLL1 to 5, ASH1, SYMD2, NSD1, and the like; histone lysine demethylases such as JHDM2a/b, UTX, JMJD3, and the like; histone acetyltransferases such as GCN5, PCAF, CBP, p300, TAF1, TIP60/PLIP, MOZ/MYST3, MORF/MYST4, SRC1, ACTR, P160, CLOCK, and the like; and DNA demethylases such as Ten-Eleven Translocation (TET) dioxygenase 1 (TET1CD), TET1, DME, DML1, DML2, ROS1, and the like.

Examples of proteins (or fragments thereof) that can be used as a fusion partner to decrease transcription include but are not limited to: transcriptional repressors such as the Kruppel associated box (KRAB or SKD); KOX1 repression domain; the Mad mSIN3 interaction domain (SID); the ERF repressor domain (ERD), the SRDX repression domain (e.g., for repression in plants), and the like; histone lysine methyltransferases such as Pr-SET7/8, SUV4-20H1, RIZ1, and the like; histone lysine demethylases such as JMJD2A/JHDM3A, JMJD2B, JMJD2C/GASC1, JMJD2D, JARID1A/RBP2, JARID1B/PLU-1, JARID 1C/SMCX, JARID1D/SMCY, and the like; histone lysine deacetylases such as HDAC1, HDAC2, HDAC3, HDAC8, HDAC4, HDAC5, HDAC7, HDAC9, SIRT1, SIRT2, HDAC11, and the like; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), METI, DRM3 (plants), ZMET2, CMT1, CMT2 (plants), and the like; and periphery recruitment elements such as Lamin A, Lamin B, and the like.

In some cases, the fusion partner to a CasX variant has enzymatic activity that modifies the target nucleic acid (e.g., ssRNA, dsRNA, ssDNA, dsDNA). Examples of enzymatic activity that can be provided by the fusion partner include but are not limited to: nuclease activity such as that provided by a restriction enzyme (e.g., FokI nuclease), methyltransferase activity such as that provided by a methyltransferase (e.g., HhaI DNA m5c-methyltransferase (M.HhaI), DNA methyltransferase 1 (DNMT1), DNA methyltransferase 3a (DNMT3a), DNA methyltransferase 3b (DNMT3b), METI, DRM3 (plants), ZMET2, CMT1, CMT2 (plants), and the like); demethylase activity such as that provided by a demethylase (e.g., Ten-Eleven Translocation (TET) dioxygenase 1 (TET 1 CD), TET1, DME, DML1, DML2, ROS1, and the like), DNA repair activity, DNA damage activity, deamination activity such as that provided by a deaminase (e.g., a cytosine deaminase enzyme, e.g., an APOBEC protein such as rat apolipoprotein B mRNA editing enzyme, catalytic polypeptide 1 {APOBEC1}), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

In some cases, a CasX variant protein of the present disclosure is fused to a polypeptide selected from a domain for increasing transcription (e.g., a VP16 domain, a VP64 domain), a domain for decreasing transcription (e.g., a KRAB domain, e.g., from the Kox1 protein), a core catalytic domain of a histone acetyltransferase (e.g., histone acetyltransferase p300), a protein/domain that provides a detectable signal (e.g., a fluorescent protein such as GFP), a nuclease domain (e.g., a FokI nuclease), or a base editor (e.g., cytidine deaminase such as APOBEC1).

In some embodiments, a CasX variant comprises any one of SEQ ID NOS: 247-592 or 1147-1231, or any one of SEQ ID NOS: 270-592 or 1147-1231, or any one of SEQ ID NOS: 415-592 or 1147-1231, or a sequence of Table 3, fused to a polypeptide selected from the group consisting of a domain for decreasing transcription, a domain with enzymatic activity, a core catalytic domain of a histone acetyltransferase, a protein/domain that provides a detectable signal, a nuclease domain, and a base editor. In some embodiments, a CasX variant comprises any one of SEQ ID NOS: 247-592 or 1147-1231 fused to a polypeptide selected from the group consisting of a domain for decreasing transcription, a domain with enzymatic activity, a core catalytic domain of a histone acetyltransferase, a protein/domain that provides a detectable signal, a nuclease domain, and a base editor. In some embodiments, a CasX variant comprises any one of SEQ ID NOS: 270-592 or 1147-1231 fused to a polypeptide described supra. In some embodiments, a CasX variant comprises any one of SEQ ID NOS: 415-592 or 1147-1231 fused to a polypeptide described supra. In some embodiments, a CasX variant comprises any one of SEQ ID NOS: 760-789 fused to a polypeptide selected from the group consisting of a domain for decreasing transcription, a domain with enzymatic activity, a core catalytic domain of a histone acetyltransferase, a protein/ domain that provides a detectable signal, a nuclease domain, and a base editor. In some embodiments, a CasX variant comprises any one of SEQ ID NOS: 411-592 fused to a polypeptide selected from the group consisting of a domain for decreasing transcription, a domain with enzymatic activity, a core catalytic domain of a histone acetyltransferase, a protein/domain that provides a detectable signal, a nuclease domain, and a base editor.

In some cases, a reference CasX protein or CasX variant of the present disclosure is fused to a base editor. Base editors include those that can alter a guanine, adenine, cytosine, thymine, or uracil base on a nucleoside or nucleotide. Base editors include, but are not limited to an adenosine deaminase, cytosine deaminase (e.g., APOBEC1), and guanine oxidase. Accordingly, any of the CasX variants provided herein may comprise (i.e., are fused to) a base editor; for example a CasX variant of the disclosure may be fused to an adenosine deaminase, a cytosine deaminase, or a guanine oxidase. In exemplary embodiments, a CasX variant of the disclosure comprising any one of SEQ ID NOS: 247-592 or 1147-1231 is fused to an adenosine deaminase, cytosine deaminase, or a guanine oxidase. In further exemplary embodiments, a CasX variant of the disclosure comprising any one of SEQ ID NOS: 270-592 or 1147-1231 is fused to an adenosine deaminase, cytosine deaminase, or a guanine oxidase. In further exemplary embodiments, a CasX variant of the disclosure comprising any one of SEQ ID NOS: 415-592 or 1147-1231 is fused to an adenosine deaminase, cytosine deaminase, or a guanine oxidase.

In some cases, the fusion partner to a CasX variant has enzymatic activity that modifies a protein associated with the target nucleic acid (e.g., ssRNA, dsRNA, ssDNA, dsDNA) (e.g., a histone, an RNA binding protein, a DNA binding protein, and the like). Examples of enzymatic activity (that modifies a protein associated with a target nucleic acid) that can be provided by the fusion partner with a CasX variant include but are not limited to: methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB 1, and the like, SET1A, SET1B, MLL1 to 5, ASH1, SMYD2, NSD1, DOT1 like histone lysine methyltransferase (DOT1L), Pr-SET7/8, lysine methyltransferase 5B (SUV4-20H1), enhancer of zeste 2 polycomb repressive complex 2 subunit (EZH2), PR/SET domain 2 (RIZ1), demethylase activity such as that provided by a histone demethylase (e.g., Lysine Demethylase 1A (KDM1A also known as LSD1), JHDM2a/b, JMJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HB01/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

Additional examples of suitable fusion partners to a CasX variant are (i) a dihydrofolate reductase (DHFR) destabilization domain (e.g., to generate a chemically controllable subject RNA-guided polypeptide), and (ii) a chloroplast transit peptide.

In some embodiments, a CasX variant comprises any one of SEQ ID NOS: 247-592 or 1147-1231, or any one of SEQ ID NOS: 270-592 or 1147-1231, or any one of SEQ ID NOS: 415-592 or 1147-1231, or a sequence of Table 3, and a chloroplast transit peptide including, but are not limited to:

(SEQ ID NO: 338)
MASMISSSAVTTVSRASRGQSAAMAPFGGLKSMTGFPVRKVNTDITSITSN

GGRVKCMQVWPPIGKKKFETLSYLPPLTRDSRA;

(SEQ ID NO: 339)
MASMISSSAVTTVSRASRGQSAAMAPFGGLKSMTGFPVRKVNTDITSITSN

GGRVKS;

(SEQ ID NO: 340)
MASSMLSSATMVASPAQATMVAPFNGLKSSAAFPATRKANNDITSITSNGG

RVNCMQVWPPIEKKKFETLSYLPDLTDSGGRVNC;

(SEQ ID NO: 341)
MAQVSRICNGVQNPSLISNLSKSSQRKSPLSVSLKTQQHPRAYPISSSWGL

KKSGMTLIGSELRPLKVMSSVSTAC;

(SEQ ID NO: 342)
MAQVSRICNGVWNPSLISNLSKSSQRKSPLSVSLKTQQHPRAYPISSSWGL

KKSGMTLIGSELRPLKVMSSVSTAC;

(SEQ ID NO: 343)
MAQINNMAQGIQTLNPNSNFHKPQVPKSSSFLVFGSKKLKNSANSMLVLKK

DSIFMQLFCSFRISASVATAC;

(SEQ ID NO: 344)
MAALVTSQLATSGTVLSVTDRFRRPGFQGLRPRNPADAALGMRTVGASAAP

KQSRKPHRFDRRCLSMVV;

(SEQ ID NO: 345)
MAALTTSQLATSATGFGIADRSAPSSLLRHGFQGLKPRSPAGGDATSLSVT

TSARATPKQQRSVQRGSRRFPSVVVC;

(SEQ ID NO: 346)
MASSVLSSAAVATRSNVAQANMVAPFTGLKSAASFPVSRKQNLDITSIASN

GGRVQC;

(SEQ ID NO: 347)
MESLAATSVFAPSRVAVPAARALVRAGTVVPTRRTSSTSGTSGVKCSAAVT

PQASPVISRSAAAA;
and (SEQ ID NO: 348)
MGAAATSMQSLKFSNRLVPPSRRLSPVPNNVTCNNLPKSAAPVRTVKCCAS

SWNSTINGAAATTNGASAASS.

In some cases, a CasX variant protein of the present disclosure can include an endosomal escape peptide. In some cases, an endosomal escape polypeptide comprises the amino acid sequence GLFXALLXLLXSLWXLLLXA (SEQ ID NO: 349), wherein each X is independently selected from lysine, histidine, and arginine. In some cases, an endosomal escape polypeptide comprises the amino acid sequence GLFHALLHLLHSLWHLLLHA (SEQ ID NO: 350), or HHHHHHHHH (SEQ ID NO: 351). In some embodiments, a CasX variant comprises a sequence of any one of SEQ ID NOS: 247-592 or 1147-1231, or any one of SEQ ID NOS: 270-592 or 1147-1231, or any one of SEQ ID NOS: 415-592 or 1147-1231, or a sequence of Table 3, and an endosomal escape polypeptide.

Non-limiting examples of suitable fusion partners for a CasX variant for use when targeting ssRNA target nucleic acids include (but are not limited to): splicing factors (e.g., RS domains); protein translation components (e.g., translation initiation, elongation, and/or release factors; e.g., eukaryotic translation initiation factor 4 gamma {eIF4G}); RNA methylases; RNA editing enzymes (e.g., RNA deaminases, e.g., adenosine deaminase acting on RNA (ADAR), including A to I and/or C to U editing enzymes); helicases; RNA-binding proteins; and the like. It is understood that a heterologous polypeptide can include the entire protein or in some cases can include a fragment of the protein (e.g., a functional domain).

In some embodiments, a CasX variant of any one of SEQ ID NOS: 247-592 or 1147-1231, or any one of SEQ ID NOS: 270-592 or 1147-1231, or any one of SEQ ID NOS: 415-592 or 1147-1231, or a sequence of Table 3, comprises a fusion partner of any domain capable of interacting with ssRNA (which, for the purposes of this disclosure, includes intramolecular and/or intermolecular secondary structures, e.g., double-stranded RNA duplexes such as hairpins, stem-loops, etc.), whether transiently or irreversibly, directly or indirectly, including but not limited to an effector domain selected from the group comprising; endonucleases (for example RNase III, the CRR22 DYW domain, Dicer, and PIN (PilT N-terminus) domains from proteins such as SMGS and SMG6); proteins and protein domains responsible for stimulating RNA cleavage (for example cleavage and polyadenylation specific factor {CPSF}, cleavage stimulation factor {CstF}, CFIm and CFIIm); exonucleases (for example chromatin-binding exonuclease XRN1 (XRN-1) or Exonuclease T); deadenylases (for example DNA 5'-adenosine monophosphate hydrolase {HNT3}); proteins and protein domains responsible for nonsense mediated RNA decay (for example UPF1 RNA helicase and ATPase {UPF1}, UPF2, UPF3, UPF3b, RNP SI, RNA binding motif protein 8A {Y14}, DEK proto-oncogene {DEK}, RNA-processing protein REF2 {REF2}, and Serine-arginine repetitive matrix 1 {SRm160}); proteins and protein domains responsible for stabilizing RNA (for example poly (A) binding protein cytoplasmic 1 {PABP}); proteins and protein domains responsible for repressing translation (for example argonaute RISC catalytic component 2 {Ago2} and Ago4); proteins and protein domains responsible for stimulating translation (for example Staufen); proteins and protein domains responsible for (e.g., capable of) modulating translation (e.g., translation factors such as initiation factors, elongation factors, release factors, etc., e.g., eIF4G); proteins and protein domains responsible for polyadenylation of RNA (for example poly(A) polymerase (PAP1), PAP-associated domain-containing protein; Poly(A) RNA polymerase gld-2 {GLD-2}, and Star-PAP); proteins and protein domains responsible for polyuridinylation of RNA (for example Terminal uridylyltransferase {CID1} and terminal uridylate transferase); proteins and protein domains responsible for RNA localization (for example from insulin like growth factor 2 mRNA binding protein 1 {IMP1}, Z-DNA binding protein 1 {ZBP1}, She2p, She3p, and Bicaudal-D); proteins and protein domains responsible for nuclear retention of RNA (for example Rrp6); proteins and protein domains responsible for nuclear export of RNA (for example nuclear RNA export factor 1 {TAP}, nuclear RNA export factor 1 {NXF1}, THO Complex {THO}, TREX, REF, and Aly/REF export factor {Aly}); proteins and protein domains responsible for repression of RNA splicing (for example polypyrimidine tract binding protein 1 {PTB}, KH RNA binding domain containing, signal transduction associated 1 Sam68}, and heterogeneous nuclear ribonucleoprotein A1 {hnRNP A1}); proteins and protein domains responsible for stimulation of RNA splicing (for example serine/arginine-rich (SR) domains); proteins and protein domains responsible for reducing the efficiency of transcription (for example FUS RNA binding protein {FUS (TLS)}); and proteins and protein domains responsible for stimulating transcription (for example cyclin dependent kinase 7 {CDK7} and HIV Tat). Alternatively, the effector domain may be selected from the group comprising endonucleases; proteins and protein domains capable of stimulating RNA cleavage; exonucleases; deadenylases; proteins and protein domains having nonsense mediated RNA decay activity; proteins and protein domains capable of stabilizing RNA; proteins and protein domains capable of repressing translation; proteins and protein domains capable of stimulating translation; proteins and protein domains capable of modulating translation (e.g., translation factors such as initiation factors, elongation factors, release factors, etc., e.g., eIF4G); proteins and protein domains capable of polyadenylation of RNA; proteins and protein domains capable of polyuridinylation of RNA; proteins and protein domains having RNA localization activity; proteins and protein domains capable of nuclear retention of RNA; proteins and protein domains having RNA nuclear export activity; proteins and protein domains capable of repression of RNA splicing; proteins and protein domains capable of stimulation of RNA splicing; proteins and protein domains capable of reducing the efficiency of transcription; and proteins and protein domains capable of stimulating transcription. Another suitable heterologous polypeptide is a PUF RNA-binding domain, which is described in more detail in WO2012068627, which is hereby incorporated by reference in its entirety.

Some RNA splicing factors that can be used (in whole or as fragments thereof) as a fusion partner with a CasX variant have modular organization, with separate sequence-specific RNA binding modules and splicing effector domains. For example, members of the serine/arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP A1 binds to exonic splicing silencers (ESSs) through its RRM domains and inhibits exon inclusion through a C-terminal glycine-rich domain. Some splicing factors can regulate alternative use of splice site (ss) by binding to regulatory sequences between the two alternative sites. For example, ASF/SF2 can recognize ESEs and promote the use of intron proximal sites, whereas hnRNP A1 can bind to ESSs and shift splicing towards the use of intron distal sites. One application for such factors is to generate ESFs that modulate alternative splicing of endogenous genes, particularly disease associated genes. For example, BCL2 like 1 (Bcl-x) pre-mRNA produces two splicing isoforms with two alternative 5' splice sites to encode proteins of opposite functions. The long splicing isoform Bcl-xL is a potent apoptosis inhibitor expressed in long-lived post mitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple cc-elements that are located in either the core exon region or the exon extension region (i.e., between the two alternative 5' splice sites). For more examples, see WO2010075303, which is hereby incorporated by reference in its entirety.

Further suitable fusion partners for use with a CasX variant include, but are not limited to, proteins (or fragments thereof) that are boundary elements (e.g., CTCF), proteins and fragments thereof that provide periphery recruitment (e.g., Lamin A, Lamin B, etc.), and protein docking elements (e.g., FKBP/FRB, Pil1/Aby1, etc.).

Additionally or alternatively, a CasX variant protein of the present disclosure may be fused to a polypeptide permeant domain to promote uptake by the cell. A number of permeant domains are known in the art and may be used in the non-integrating polypeptides of the present disclosure, including peptides, peptidomimetics, and non-peptide carriers. For example, WO2017/106569 and US20180363009A1, incorporated by reference herein in its entirety, describe fusion of a Cas protein with one or more nuclear localization sequences (NLS) to facilitate cell uptake. In other embodiments, a permeant peptide may be derived from the third alpha helix of *Drosophila melanogaster* transcription factor Antennapaedia, referred to as penetratin, which comprises the amino acid sequence RQIKIWFQNRRMKWKK (SEQ ID NO: 398). As another example, the permeant peptide comprises the HIV-1 tat basic region amino acid sequence, which may include, for example, amino acids 49-57 of naturally-occurring tat protein. Other permeant domains include poly-arginine motifs, for example, the region of amino acids 34-56 of HIV-1 rev protein, nona-arginine, octa-arginine, and the like. The site at which the fusion is made may be selected in order to optimize the biological activity, secretion or binding characteristics of the polypeptide. The optimal site will be determined by routine experimentation.

In some cases, a heterologous polypeptide (a fusion partner) for use with a CasX variant provides for subcellular localization; i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like). In some embodiments, a subject RNA-guided polypeptide or a conditionally active RNA-guided polypeptide and/or subject CasX fusion protein does not include a NLS so that the protein is not targeted to the nucleus, which can be advantageous; e.g., when the target nucleic acid is an RNA that is present in the cytosol. In some embodiments, a fusion partner can provide a tag (i.e., the heterologous polypeptide is a detectable label) for ease of tracking and/or purification (e.g., a fluorescent protein, e.g., green fluorescent protein (GFP), yellow fluorescent protein (YFP), red fluorescent protein (RFP), cyan fluorescent protein (CFP), mCherry, tdTomato, and the like; a histidine tag, e.g., a 6×His tag; a hemagglutinin (HA) tag; a FLAG tag; a Myc tag; and the like). In some embodiments, a CasX variant comprises any one of SEQ ID NOS: XX-XX and a subcellular localization sequence or a tag.

In some cases, a reference or CasX variant protein includes (is fused to) a nuclear localization signal (NLS). Non-limiting examples of NLSs suitable for use with a CasX variant include sequences having at least about 80%, at least about 90%, or at least about 95% identity or are identical to sequences derived from: the NLS of the SV40 virus large T-antigen, having the amino acid sequence PKKKRKV (SEQ ID NO: 352); the NLS from nucleoplasmin (e.g., the nucleoplasmin bipartite NLS with the sequence KRPAATKKAGQAKKKK (SEQ ID NO: 353); the c-myc NLS having the amino acid sequence PAAKRVKLD (SEQ ID NO: 354)) or RQRRNELKRSP (SEQ ID NO: 355); the hRNPA1 M9 NLS having the sequence NQSSNFGPMKGGNFGGRSSGPYGGGGQYFAKPRNQGGY (SEQ ID NO: 356); the sequence RMRIZFKNKGKDTAELRRRRVEVSVELRKAKKDEQILKRRNV (SEQ ID NO: 357) of the IBB domain from importin-alpha; the sequences VSRKRPRP (SEQ ID NO: 358) and PPKKARED (SEQ ID NO: 359) of the myoma T protein; the sequence PQPKKKPL (SEQ ID NO: 360) of human p53; the sequence SALIKKKKKMAP (SEQ ID NO: 361) of mouse c-abl IV; the sequences DRLRR (SEQ ID NO: 362) and PKQKKRK (SEQ ID NO: 363) of the influenza virus NS1; the sequence RKLKKKIKKL (SEQ ID NO: 364) of the Hepatitis virus delta antigen; the sequence REKKKFLKRR (SEQ ID NO: 365) of the mouse Mx1 protein; the sequence KRKGDEVDGVDEVAKKKSKK (SEQ ID NO: 366) of the human poly(ADP-ribose) polymerase; the sequence RKCLQAGMNLEARKTKK (SEQ ID NO: 367) of the steroid hormone receptors (human) glucocorticoid; the sequence PRPRKIPR (SEQ ID NO: 368) of Borna disease virus P protein (BDV-P1); the sequence PPRKKRTVV (SEQ ID NO: 369) of hepatitis C virus nonstructural protein (HCV-NSSA); the sequence NLSKKKKRKREK (SEQ ID NO: 370) of LEF1; the sequence RRPSRPFRKP (SEQ ID NO: 371) of ORF57 simirae; the sequence KRPRSPSS (SEQ ID NO: 372) of EBV LANA; the sequence KRGINDRNFWRGENERKTR (SEQ ID NO: 373) of Influenza A protein; the sequence PRPPKMARYDN (SEQ ID NO: 374) of human RNA helicase A (RHA); the sequence KRSFSKAF (SEQ ID NO: 375) of nucleolar RNA helicase II; the sequence KLKIKRPVK (SEQ ID NO: 376) of TUS-protein; the sequence PKKKRKVPPPPAAKRVKLD (SEQ ID NO: 377) associated with importin-alpha; the sequence PKTRRRPRRSQRKRPPT (SEQ ID NO: 378) from the Rex protein in HTLV-1; the sequence SRRRKANPTKLSENAKKLAKEVEN (SEQ ID NO: 379) from the EGL-13 protein of *Caenorhabditis elegans*; and the sequences KTRRRPRRSQRKRPPT (SEQ ID NO: 380), RRKKRRPRRKKRR (SEQ ID NO: 381), PKKKSRKPKKKSRK (SEQ ID NO: 382), HKKKHPDASVNFSEFSK (SEQ ID NO: 383), QRPGPYDRPQRPGPYDRP (SEQ ID NO: 384), LSPSLSPLLSPSLSPL (SEQ ID NO: 385), RGKGGKGLGKGGAKRHRK (SEQ ID NO: 386), PKRGRGRPKRGRGR (SEQ ID NO: 387), PKKKRKVPPPPAAKRVKLD (SEQ ID NO: 388), PKKKRKVPPPPKKKRKV (SEQ ID NO: 389), PAKRARRGYKC (SEQ ID NO: 63), KLGPRKATGRW (SEQ ID NO: 64), PRRKREE (SEQ ID NO: 65), PYRGRKE (SEQ ID NO:66), PLRKRPRR (SEQ ID NO: 67), PLRKRPRRGSPLRKRPRR (SEQ ID NO:68), PAAKRVKLDGGKRTADGSEFESPKKKRKV (SEQ ID NO: 69), PAAKRVKLDGGKRTADGSEFESPKKKRKVGIHGVPAA (SEQ ID NO: 70), PAAKRVKLDGGKRTADGSEFESPKKKRKVAEAAAKEAAAKEAAAKA (SEQ ID NO: 71), PAAKRVKLDGGKRTADGSEFESPKKKRKVPG (SEQ ID NO: 72), KRKGSPERGERKRHW (SEQ ID NO: 73), KRTADSQHSTPPKTKRKVEFEPKKKRKV (SEQ ID NO: 74), and PKKKRKVGGSKRTADSQHSTPPKTKRKVEFEPKKKRKV (SEQ ID NO: 75). In some embodiments, the one or more NLS are linked to the CRISPR protein or to adjacent NLS with a linker peptide wherein the linker peptide is selected from the group consisting of RS, (G)n (SEQ ID NO: 1023), (GS)n (SEQ ID NO: 1024), (GSGGS)n (SEQ ID NO: 399), (GGSGGS)n (SEQ ID NO: 400), (GGGS)n (SEQ ID NO: 401), GGSG (SEQ ID NO: 402), GGSGG (SEQ ID NO: 403), GSGSG (SEQ ID NO: 404), GSGGG (SEQ ID NO: 405), GGGSG (SEQ ID NO: 406), GSSSG (SEQ ID NO: 407), GPGP (SEQ ID NO: 408), GGP, PPP, PPAPPA (SEQ ID NO: 409), PPPG (SEQ ID NO: 24), PPPGPPP (SEQ ID NO: 410), PPP(GGGS)n (SEQ ID NO: 25), (GGGS)nPPP (SEQ ID NO: 26), AEAAAKEAAAKEAAAKA (SEQ ID NO: 1025), and TPPKTKRKVEFE (SEQ ID NO: 27), where n is 1 to 5. In general, NLS (or multiple NLSs) are of sufficient strength to drive accumulation of a CasX variant fusion protein in the nucleus of a eukaryotic cell. Detection of accumulation in the nucleus may be performed by any suitable technique. For example, a detectable marker may be fused to a CasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

The disclosure contemplates assembly of multiple NLS in various configurations for linkage to the CRISPR protein. In some embodiments, 1, 2, 3, 4 or more NLS are linked by linker peptides to the N-terminus of the CRISPR protein. In other embodiments, 1, 2, 3, 4 or more NLS are linked by linker peptides to the C-terminus of the CRISPR protein. In some embodiments, the NLS linked to the N-terminus of the CRISPR protein are identical to the NLS linked to the C-terminus. In other embodiments, the NLS linked to the N-terminus of the CRISPR protein are different to the NLS linked to the C-terminus. In some embodiments, the NLS linked to the N-terminus of the CRISPR protein are selected from the group consisting of the N-terminal sequences as set forth in Table 8. In some embodiments, the NLS linked to the C-terminus of the CRISPR protein are selected from the group consisting of the C-terminal sequences as set forth in Table 8. Detection of accumulation in the nucleus may be performed by any suitable technique. For example, a detectable marker may be fused to a reference or CasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

TABLE 8

NLS Sequences

| N-terminal Sequences | SEQ ID NO | C-terminal Sequences | SEQ ID NO |
|---|---|---|---|
| PKKKRKVGGSPKKKRKVSRQEIKRINKIRRRLVKDSNTKKAGKTGP | 219 | TLESPAAKRVKLDGGSPAAKRVKLDGGSPAAKRVKLDGGSPAAKRVKLDTLESKRPAATKKAGQAKKKKGGSKRPAATKKAGQAKKKKGGSKRPAATKKAGQAKKKKGGSKRPAATKKAGQAKKKK | 1236 |
| PKKKRKVGGSPKKKRKVGGSPKKKRKVGGSPKKKRKVSRQEIKRINKIRRRLVKDSNTKKAGKTGP | 220 | TLESKRPAATKKAGQAKKKKTLESKRPAATKKAGQAKKKKGGSKRPAATKKAGQAKKKKGGSKRPAATKKAGQAKKKKGGSKRPAATKKAGQAKKKKGGSKRPAATKKAGQAKKKK | 1237 |
| PKKKRKVGGSPKKKRKVGGSPKKKRKVGGSPKKKRKVGGSPKKKRKVGGSPKKKRKVSRQEIKRINKIRRRLVKDSNTKKAGKTGP | 221 | TLESKRPAATKKAGQAKKKKGGSKRPAATKKAGQAKKKKTLESPKKKRKVGGSPKKKRKVGGSPKKKRKVGGSPKKKRKV | 1238 |
| PAAKRVKLDGGSPAAKRVKLDSRQEIKRINKIRRRLVKDSNTKKAGKTGP | 222 | TLEGGSPKKKRKVTLESPKKKRKVGGSPKKKRKVGGSPKKKRKVGGSPKKKRKV | 1239 |
| PAAKRVKLDGGSPAAKRVKLDGGSPAAKRVKLDGGSPAAKRVKLDSRQEIKRINKIRRRLVKDSNTKKAGKTGP | 223 | TLEGGSPKKKRKVTLESPAAKRVKLDGGSPAAKRVKLDGGSPAAKRVKLDGGSPAAKRVKLD | 1240 |
| PAAKRVKLDGGSPAAKRVKLDGGSPAAKRVKLDGGSPAAKRVKLDGGSPAAKRVKLDSRQEIKRINKIRRRLVKDSNTKKAGKTGP | 224 | TLEGGSPKKKRKVTLESPAAKRVKLDGGSPAAKRVKLDGGSPAAKRVKLDGGSPAAKRVKLDGGSPAAKRVKLD | 1241 |
| KRPAATKKAGQAKKKKSRDISRQEIKRINKIRRRLVKDSNTKKAGKTGP | 225 | TLEGGSPKKKRKVTLESKRPAATKKAGQAKKKK | 1242 |
| KRPAATKKAGQAKKKKSRQEIKRINKIRRRLVKDSNTKKAGKTGP | 226 | TLEGGSPKKKRKVTLESKRPAATKKAGQAKKKKGGSKRPAATKKAGQAKKKK | 1243 |
| KRPAATKKAGQAKKKKGGSKRPAATKKAGQAKKKKSRDISRQEIKRINKIRRRLVKDSNTKKAGKTGP | 227 | TLEGGSPKKKRKVTLEGGSPKKKRKV | 1244 |
| KRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP | 228 | TLEGGSPKKKRKVTLEGGSPKKKRKV | 1244 |

TABLE 8-continued

NLS Sequences

| N-terminal Sequences | SEQ ID NO | C-terminal Sequences | SEQ ID NO |
|---|---|---|---|
| KRPAATKKAGQAKKKKGGSKRPAATKKAGQ AKKKKGGSKRPAATKKAGQAKKKKGGSKRP AATKKAGQAKKKKGGSKRPAATKKAGQAKK KKGGSKRPAATKKAGQAKKKKSRDISRQEI KRINKIRRRLVKDSNTKKAGKTGP | 229 | TLEGGSPKKKRKVTLEGGSPKKKRKV | 1244 |
| PKKKRKVGGSPKKKRKVGGSPKKKRKVGGS PKKKRKVSRDISRQEIKRINKIRRRLVKDS NTKKAGKTGP | 230 | TLEGGSPKKKRKVTLEGGSPKKKRKV | 1244 |
| PKKKRKVGGSPKKKRKVGGSPKKKRKVGGS PKKKRKVSRDISRQEIKRINKIRRRLVKDS NTKKAGKTGP | 230 | TLEGGSPKKKRKVTLEGGSPKKKRKV | 1244 |
| PAAKRVKLDGGSPAAKRVKLDGGSPAAKRV KLDGGSPAAKRVKLDSRDISRQEIKRINKI RRRLVKDSNTKKAGKTGP | 231 | TLEVGPKRTADSQHSTPPKTKRKVEFE PKKKRKVTLEGGSPKKKRKV | 1245 |
| PAAKRVKLDGGSPAAKRVKLDGGSPAAKRV KLDGGSPAAKRVKLDGGSPAAKRVKLDGGS PAAKRVKLDSRDISRQEIKRINKIRRRLVK DSNTKKAGKTGP | 232 | TLEVGGGSGGGSKRTADSQHSTPPKTK RKVEFEPKKKRKVTLEGGSPKKKRKV | 1246 |
| KRPAATKKAGQAKKKKSRDISRQEIKRINK IRRRLVKDSNTKKAGKTGP | 225 | TLEVAEAAAKEAAAKEAAAKAKRTADS QHSTPPKTKRKVEFEPKKKRKVTLEGG SPKKKRKV | 1247 |
| KRPAATKKAGQAKKKKGGSKRPAATKKAGQ AKKKKSRDISRQEIKRINKIRRRLVKDSNT KKAGKTGP | 227 | TLEVGPPKKKRKVGGSKRTADSQHSTP PKTKRKVEFEPKKKRKVTLEGGSPKKK RKV | 1248 |
| PAAKRVKLDGGKRTADGSEFESPKKKRKVG GSSRDISRQEIKRINKIRRRLVKDSNTKKA GKTGP | 233 | TLEVGPAEAAAKEAAAKEAAAKAPAAK RVKLDTLEGGSPKKKRKV | 1249 |
| PAAKRVKLDGGKRTADGSEFESPKKKRKVP PPPGSRDISRQEIKRINKIRRRLVKDSNTK KAGKTGP | 234 | TLEVGPGGGSGGGSGGGSPAAKRVKLD TLEVGPKRTADSQHSTPPKTKRKVEFE PKKKRKV | 1250 |
| PAAKRVKLDGGKRTADGSEFESPKKKRKVG IHGVPAAPGSRDISRQEIKRINKIRRRLVK DSNTKKAGKTGPVEFEPKKKRKV | 235 | TLEVGPPKKKRKVPPPPAAKRVKLDTL EVGGGSGGGSKRTADSQHSTPPKTKRK | 1251 |
| PAAKRVKLDGGKRTADGSEFESPKKKRKVG GGSGGGSPGSRDISRQEIKRINKIRRRLVK DSNTKKAGKTGP | 236 | TLEVGPPAAKRVKLDTLEVAEAAAKEA AAKEAAAKAKRTADSQHSTPPKTKRKV EFEPKKKRKV | 1252 |
| PAAKRVKLDGGKRTADGSEFESPKKKRKVP GGGSGGGSPGSRDISRQEIKRINKIRRRLV KDSNTKKAGKTGP | 239 | TLEVGPKRTADSQHSTPPKTKRKVEFE PKKKRKVTLEVGPPKKKRKVGGSKRTA DSQHSTPPKTKRKVEFEPKKKRKV | 1253 |
| PAAKRVKLDGGKRTADGSEFESPKKKRKVA EEAAAKEAAAKEAAAKAPGSRDISRQEIKRI NKIRRRLVKDSNTKKAGKTGP | 983 | TLEVGGGSGGGSKRTADSQHSTPPKTK RKVEFEPKKKRKVTLEVGPAEAAAKEA AAKEAAAKAPAAKRVKLD | 1254 |
| PAAKRVKLDGGKRTADGSEFESPKKKRKVP GSRDISRQEIKRINKIRRRLVKDSNTKKAG KTGP | 984 | GSKRPAATKKAGQAKKKKTLEVGPGGG SGGGSGGGSPAAKRVKLD | 1255 |
| PAAKRVKLDGGSPKKKRKVGGSSRDISRQE IKRINKIRRRLVKDSNTKKAGKTGP | 985 | GSKRPAATKKAGQAKKKKTLEVGPPKK KRKVPPPPAAKRVKLD | 1256 |
| PAAKRVKLDPPPPKKKRKVPGSRDISRQEI KRINKIRRRLVKDSNTKKAGKTGP | 986 | GSKRPAATKKAGQAKKKKTLEVGPPAA KRVKLD | 1257 |
| PAAKRVKLDPGRSDISRQEIKRINKIRRR LVKDSNTKKAGKTGP | 987 | GSPKKKRKVTLEVGPKRTADSQHSTPP KTKRKVEFEPKKKRKV | 1258 |
| PKKKRKVSRDISRQEIKRINKIRRRLVKDS NTKKAGKTGP | 988 | GSKRPAATKKAGQAKKKKTLEVGGGSG GGSKRTADSQHSTPPKTKRKVEFEPKK KRKV | 1259 |
| PAAKRVKLDGGKRTADGSEFESPKKKRKVG GSSRDISRQEIKRINKIRRRLVKDSNTKKA GKTGP | 233 | GSKRPAATKKAGQAKKKKGSKRPAATK KAGQAKKKK | 1260 |

TABLE 8-continued

NLS Sequences

| N-terminal Sequences | SEQ ID NO | C-terminal Sequences | SEQ ID NO |
|---|---|---|---|
| PAAKRVKLDGGKRTADGSEFESPKKKRKVGGGSGGGSPGSRDISRQEIKRINKIRRRLVKDSNTKKAGKTGP | 236 | GSKRPAATKKAGQAKKKKGSKRPAATKKAGQAKKKK | 1261 |
| PKKKRKVSRQEIKRINKIRRRLVKDSNTKKAGKTGP | 989 | GSKRPAATKKAGQAKKKKGSKRPAATKKAGQAKKKK | 1262 |
| PKKKRKVGGSPKKKRKVGGSPKKKRKVGGSPKKKRKVSRQEIKRINKIRRRLVKDSNTKKAGKTGP | 220 | GSPKKKRKVGSPKKKRKV | 1263 |
| PKKKRKVGGSPKKKRKVGGSPKKKRKVGGSPKKKRKVGGSPKKKRKVGGSPKKKRKVSRQEIKRINKIRRRLVKDSNTKKAGKTGP | 221 | GGGSGGGSKRTADSQHSTPPKTKRKVEFEPKKKRKVGSKRPAATKKAGQAKKKK | 1264 |
| PAAKRVKLDSRQEIKRINKIRRRLVKDSNTKKAGKTGP | 990 | GPPKKKRKVGGSKRTADSQHSTPPKTKRKVEFEPKKKRKVGSKRPAATKKAGQAKKKK | 1265 |
| PAAKRVKLDGGSPAAKRVKLDSRQEIKRINKIRRRLVKDSNTKKAGKTGP | 222 | TGGGPGGGAAAGSGSPKKKRKVGSGSGSKRPAATKKAGQAKKKK | 1266 |
| PAAKRVKLDGGSPAAKRVKLDGGSPAAKRVKLDGGSPAAKRVKLDSRQEIKRINKIRRRLVKDSNTKKAGKTGP | 223 | GPKRTADSQHSTPPKTKRKVEFEPKKKRKVGSKRPAATKKAGQAKKKK | 1267 |
| PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGP | 224 | AEAAAKEAAAKEAAAKAKRTADSQHSTPPKTKRKVEFEPKKKRKVGSPKKKRKV | 1268 |
| KRPAATKKAGQAKKKKSRQEIKRINKIRRRLVKDSNTKKAGKTGP | 226 | GPPKKKRKVPPPPAAKRVKLDGGGSGGGSKRTADSQHSTPPKTKRKVEFEPKKKRKV | 1269 |
| TSPKKKRKVALEYPYDVPDYA | 991 | GSPAAKRVKLDGGSPAAKRVKLDGGSPAAKRVKLDGGSPAAKRVKLDGGSPAAKRVKLDGGSPAAKRVKLDGPPKKKRKVGGSKRTADSQHSTPPKTKRKVEFEPKKKRKV | 1270 |
| TLESKRPAATKKAGQAKKKKAPGEYPYDVPDYA | 992 | GSPAAKRVKLDGGSPAAKRVKLDGGSPKKKRKVGGSPKKKRKVTGGGPGGGAAAGSGSPKKKRKVGSGS | 1271 |
| GSKRPAATKKAGQAKKKKYPYDVPDYA | 993 | GSKRPAATKKAGQAKKKKGGSKRPAATKKAGQAKKKKGPKRTADSQHSTPPKTKRKVEFEPKKKRKV | 1272 |
| TLESKRPAATKKAGQAKKKKGGSKRPAATKKAGQAKKKKAPGEYPYDVPDYATSPKKKRKVALEYPYDVPDYA | 1274 | GSKRPAATKKAGQAKKKKGGSKRPAATKKAGQAKKKKAEAAAKEAAAKEAAAKAKRTADSQHSTPPKTKRKVEFEPKKKRKV | 1273 |
| TLESKRPAATKKAGQAKKKKGGSKRPAATKKAGQAKKKKGGSKRPAATKKAGQAKKKKGGSKRPAATKKAGQAKKKKTSPKKKRKVALEYPYDVPDYA | 1275 | GPPKKKRKVPPPPAAKRVKLD | 1018 |
| TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKTSPKKKRKVALEYPYDVPDYA | 1276 | GSPAAKRVKLDGGSPAAKRVKLDGGSPAAKRVKLDGGSPAAKRVKLDGGSPAAKRVKLD | 1019 |
| TLESPKKKRKVGGSPKKKRKVGGS PKKKRKVGGSPKKKRKVTLESKRPAATKKAGQAKKKKAPGEYPYDVPDYA | 1277 | GSPAAKRVKLGGSPAAKRVKLGGSPKKKRKVGGSPKKKRKV | 1020 |
| TLESPKKKRKVGGSPKKKRKVGGSPKKKRKVGGSPKKKRKVGSKRPAATKKAGQAKKKKYPYDVPDYA | 1278 | GSKRPAATKKAGQAKKKKGGSKRPAATKKAGQAKKKK | 1021 |

TABLE 8-continued

NLS Sequences

| N-terminal Sequences | SEQ ID NO | C-terminal Sequences | SEQ ID NO |
|---|---|---|---|
| TLESPAAKRVKLDGGSPAAKRVKLDGGSPA AKRVKLDGGSPAAKRVKLDTLESKRPAATK KAGQAKKKKGGSKRPAATKKAGQAKKKKAP GEYPYDVPDYA | 1279 | GSKRPAATKKAGQAKKKKGGSKRPAAT KKAGQAKKKK | 1021 |

In some embodiments, a CasX variant comprises any one of SEQ ID NOS: 247-592 or 1147-1231, or any one of SEQ ID NOS: 270-592 or 1147-1231, or any one of SEQ ID NOS: 415-592 or 1147-1231, or a sequence of Table 3, fused to one or more NLS of any one of SEQ ID NOS: 63-75, 219-236, 239, 352-389, 983-1021, 1237-1278 or any of the sequences of Table 8. In some embodiments, one or more NLS are fused to or near the N-terminus of the CasX variant. In some embodiments, one or more NLS are fused to or near the C-terminus of the CasX variant. In some embodiments, one or more NLS are fused to both the N- and C-terminus of the CasX variant. In some embodiments, an NLS is linked to another NLS by a linker.

In some cases, a reference or CasX variant fusion protein includes a "Protein Transduction Domain" or PTD (also known as a CPP—cell penetrating peptide), which refers to a protein, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from an extracellular space to an intracellular space, or from the cytosol to within an organelle. In some embodiments, a PTD is covalently linked to the amino terminus of a reference or CasX variant fusion protein. In some embodiments, a PTD is covalently linked to the carboxyl terminus of a reference or CasX variant fusion protein. In some cases, the PTD is inserted internally in the sequence of a reference or CasX variant fusion protein at a suitable insertion site. In some cases, a reference or CasX variant fusion protein includes (is conjugated to, is fused to) one or more PTDs (e.g., two or more, three or more, four or more PTDs). In some cases, a PTD includes one or more nuclear localization signals (NLS). Examples of PTDs include but are not limited to peptide transduction domain of HIV TAT comprising YGRKKRRQRRR (SEQ ID NO: 390), RKKRRQRR (SEQ ID NO: 391); YARAAARQARA (SEQ ID NO: 392); THRLPRRRRRR (SEQ ID NO: 393); and GGRRARRRRRR (SEQ ID NO: 394); a polyarginine sequence comprising a number of arginines sufficient to direct entry into a cell (e.g., 3, 4, 5, 6, 7, 8, 9, 10, or 10-50 arginines, SEQ ID NO: 1026); a VP22 domain (Zender et al. (2002) Cancer Gene Ther. 9(6):489-96); an *Drosophila* Antennapedia protein transduction domain (Noguchi et al. (2003) Diabetes 52(7): 1732-1737); a truncated human calcitonin peptide (Trehin et al. (2004) Pharm. Research 21:1248-1256); polylysine (Wender et al. (2000) Proc. Natl. Acad. Sci. USA 97: 13003-13008); RRQRRTSKLMKR (SEQ ID NO: 395); Transportan GWTLNSAGYLLGKINL-KALAALAKKIL (SEQ ID NO: 396); KALAWEAK-LAKALAKALAKHLAKALAKALKCEA (SEQ ID NO: 397); and RQIKIWFQNRRMKWKK (SEQ ID NO: 398). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane. In some embodiments, a CasX variant comprises any one of SEQ ID NOS: 247-592 or 1147-1231, or any one of SEQ ID NOS: 270-592 or 1147-1231, or any one of SEQ ID NOS: 415-592 or 1147-1231, or a sequence of Table 3 and a PTD.

In some embodiments, a CasX variant fusion protein can include a CasX protein that is linked to an internally inserted heterologous amino acid or heterologous polypeptide (a heterologous amino acid sequence) via a linker polypeptide (e.g., one or more linker polypeptides). In some embodiments, a reference or CasX variant fusion protein can be linked at the C-terminal and/or N-terminal end to a heterologous polypeptide (fusion partner) via a linker polypeptide (e.g., one or more linker polypeptides). The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers are generally produced by using synthetic, linker-encoding oligonucleotides to couple the proteins. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use. Example linker polypeptides include glycine polymers (G)n, glycine-serine polymer (including, for example, (GS)n (SEQ ID NO: 1024), (GSGGS)n (SEQ ID NO: 399), (GGSGGS)n (SEQ ID NO: 400), and (GGGS)n (SEQ ID NO: 401), where n is an integer of at least one), glycine-alanine polymers, alanine-serine polymers, glycine-proline polymers, proline polymers and proline-alanine polymers. Example linkers can comprise amino acid sequences including, but not limited to RS, (G)n, (GS)n (SEQ ID NO: 1024), (GSGGS)n (SEQ ID NO: 399), (GGSGGS)n (SEQ ID NO: 400), (GGGS)n (SEQ ID NO: 401), GGSG (SEQ ID NO: 402), GGSGG (SEQ ID NO: 403), GSGSG (SEQ ID NO: 404), GSGGG (SEQ ID NO: 405), GGGSG (SEQ ID NO: 406), GSSSG (SEQ ID NO: 407), GPGP (SEQ ID NO:)408, GGP, PPP, PPAPPA (SEQ ID NO: 409), PPPG (SEQ ID NO: 24), PPPGPPP (SEQ ID NO: 410), PPP(GGGS)n (SEQ ID NO:

25), (GGGS)nPPP (SEQ ID NO: 26), AEAAAKEAAAKEAAAKA (SEQ ID NO: 1025), and TPPKTKRKVEFE (SEQ ID NO: 27), wherein n is 1 to 5. The ordinarily skilled artisan will recognize that design of a peptide conjugated to any elements described above can include linkers that are all or partially flexible, such that the linker can include a flexible linker as well as one or more portions that confer less flexible structure.

V. Methods of Making CasX Variant Protein and gRNA Variants

The CasX variant proteins and gRNA variants as described herein may be constructed through a variety of methods. Such methods may include, for example, Deep Mutational Evolution (DME), described below and in the Examples, as well as in applications PCT/US20/36506 and WO2020247883A2, incorporated by reference herein.

a. Deep Mutational Evolution (DME)

Figure 16:
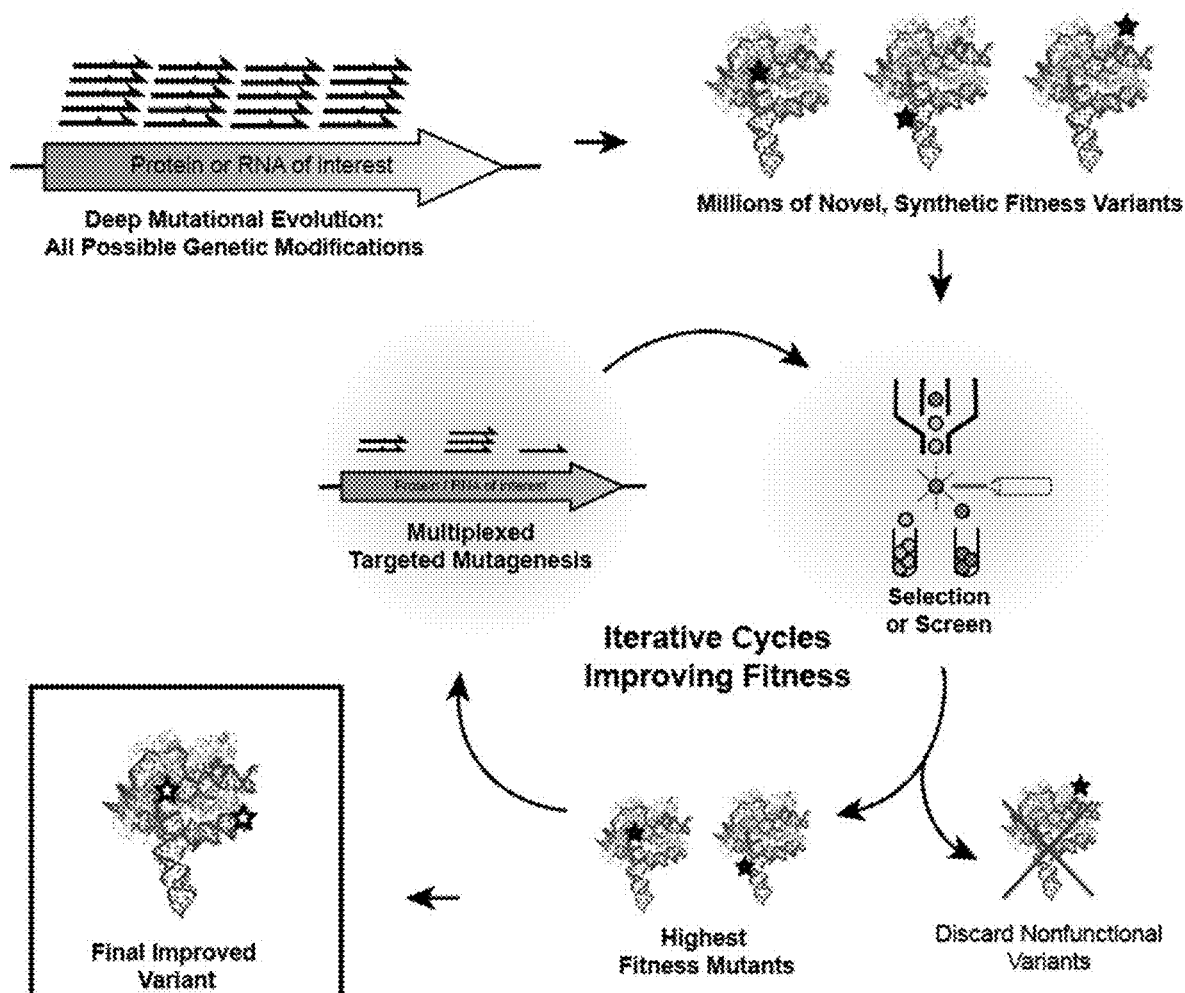
FIG. 16 is a diagram showing an exemplary method of making CasX protein and guide RNA variants of the disclosure using Deep Mutational Evolution (DME). In some exemplary embodiments, DME builds and tests nearly every possible mutation, insertion and deletion in a biomolecule and combinations/multiples thereof, and provides a near comprehensive and unbiased assessment of the fitness landscape of a biomolecule and paths in sequence space towards desired outcomes. As described herein, DME can be applied to both CasX protein and guide RNA.
Figure 17A:
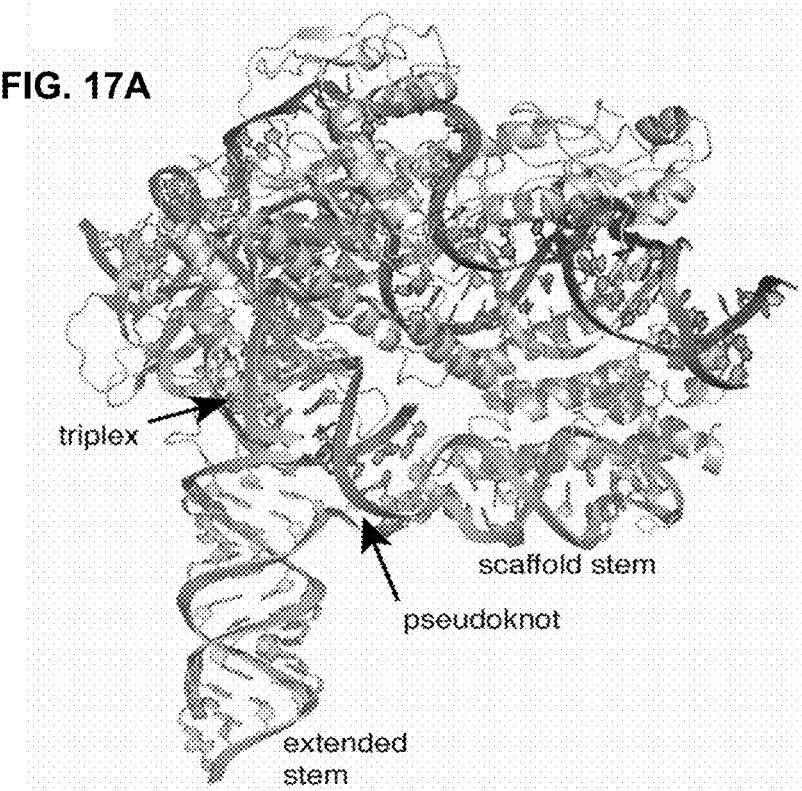
FIG. 17A depicts the CryoEM structure of Deltaproteobacteria CasX protein:sgRNA RNP complex (PDB id: 6YN2), including two stem loops, a pseudoknot, and a triplex, as described in Example 13.
Figure 17B:
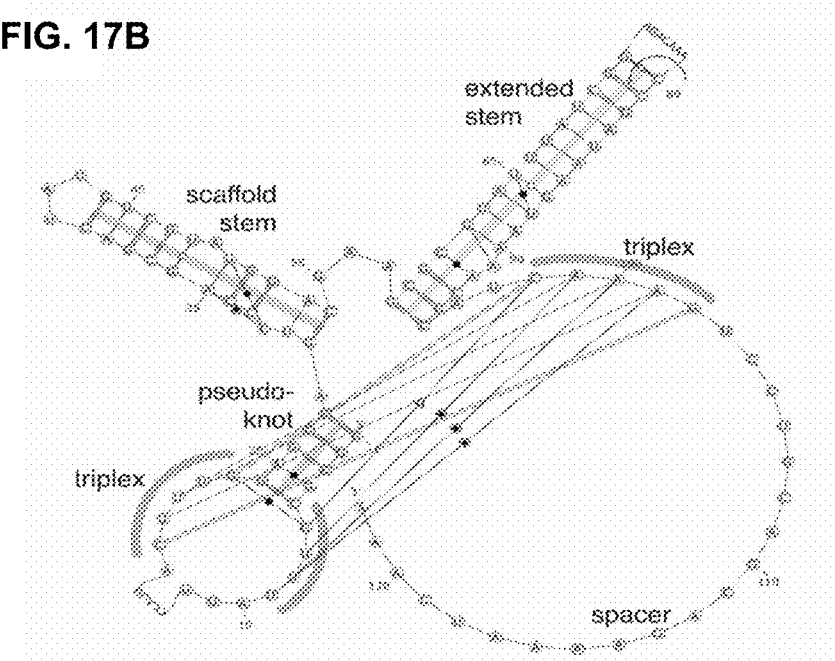
FIG. 17B depicts the secondary structure of the sgRNA of SEQ ID NO: 4 identified from the structure shown in (A) using the tool RNAPDBee 2.0 (rnapdbee.cs.put.poznan.pl/, using the tools 3DNA/DSSR, and using the VARNA visualization tool). RNA regions are indicated. Residues that were not evident in the PDB crystal structure file are indicated by plain-text letters (i.e., not encircled), and are not included in residue numbering.

In some embodiments, DME is used to identify CasX protein and sgRNA scaffold variants with improved function. The DME method, in some embodiments, comprises building and testing a comprehensive set of mutations to a starting biomolecule to produce a library of biomolecule variants; for example, a library of CasX variant proteins or sgRNA scaffold variants. DME can encompass making all possible substitutions, as well as all possible small insertions, and all possible deletions of amino acids (in the case of proteins) or nucleotides (in the case of RNA or DNA) to the starting biomolecule. A schematic illustrating DME methods is shown in FIG. 16. In some embodiments, DME comprises a subset of all such possible substitutions, insertions, and deletions. In certain embodiments of DME, one or more libraries of variants are constructed, evaluated for functional changes, and this information used to construct one or more additional libraries. Such iterative construction and evaluation of variants may lead, for example, to identification of mutational themes that lead to certain functional outcomes, such as regions of the protein or RNA that, when mutated in a certain way, lead to one or more improved functions. Layering of such identified mutations may then further improve function, for example through additive or synergistic interactions. DME comprises library design, library construction, and library screening. In some embodiments, multiple rounds of design, construction, and screening are undertaken.

b. Library Design

DME methods produce variants of biomolecules, which are polymers of many monomers. In some embodiments, the biomolecule comprises a protein or a ribonucleic acid (RNA) molecule, wherein the monomer units are amino acids or ribonucleotides, respectively. The fundamental units of biomolecule mutation comprise either: (1) exchanging one monomer for another monomer of different identity (substitutions); (2) inserting one or more additional monomer in the biomolecule (insertions); or (3) removing one or more monomer from the biomolecule (deletions). DME libraries comprising substitutions, insertions, and deletions, alone or in combination, to any one or more monomers within any biomolecule described herein, are considered within the scope of the invention.

In some embodiments, DME is used to build and test the comprehensive set of mutations to a biomolecule, encompassing all possible substitutions, as well as small insertions and deletions of amino acids (in the case of proteins) or nucleotides (in the case of RNA). The construction and functional readout of these mutations can be achieved with a variety of established molecular biology methods. In some embodiments, the library comprises a subset of all possible modifications to monomers. For example, in some embodiments, a library collectively represents a single modification of one monomer, for at least 10% of the total monomer locations in a biomolecule, wherein each single modification is selected from the group consisting of substitution, single insertion, and single deletion. In some embodiments, the library collectively represents the single modification of one monomer, for at least 5%, at least 10%, at least 20%, at least 30%, at least 40%, at least 50%, at least 60%, at least 70%, at least 80%, at least 90%, at least 95%, or up to 100% of the total monomer locations in a starting biomolecule. In certain embodiments, for a certain percentage of the total monomer locations in a starting biomolecule, the library collectively represents each possible single modification of a one monomer, such as all possible substitutions with the 19 other naturally occurring amino acids (for a protein) or 3 other naturally occurring ribonucleotides (for RNA), insertion of each of the 20 naturally occurring amino acids (for a protein) or 4 naturally occurring ribonucleotides (for RNA), or deletion of the monomer. In still further embodiments, insertion at each location is independently greater than one monomer, for example insertion of two or more, three or more, or four or more monomers, or insertion of between one to four, between two to four, or between one to three monomers. In some embodiments, deletion at location is independently greater than one monomer, for example deletion of two or more, three or more, or four or more monomers, or deletion of between one to four, between two to four, or between one to three monomers. Examples of such libraries of CasX variants and gRNA variants are described in Examples 14 and 15, respectively.

In some embodiments, the biomolecule is a protein and the individual monomers are amino acids. In those embodiments where the biomolecule is a protein, the number of possible DME mutations at each monomer (amino acid) position in the protein comprise 19 amino acid substitutions, 20 amino acid insertions and 1 amino acid deletion, leading to a total of 40 possible mutations per amino acid in the protein.

In some embodiments, a DME library of CasX variant proteins comprising insertions is a 1 amino acid insertion library, a 2 amino acid insertion library, a 3 amino acid insertion library, a 4 amino acid insertion library, a 5 amino acid insertion library, a 6 amino acid insertion library, a 7 amino acid insertion library, an 8 amino acid insertion library, a 9 amino acid insertion library or a 10 amino acid insertion library. In some embodiments, a DME library of CasX variant proteins comprising insertions comprises between 1 and 4 amino acid insertions.

In some embodiments, the biomolecule is RNA. In those embodiments where the biomolecule is RNA, the number of possible DME mutations at each monomer (ribonucleotide) position in the RNA comprises 3 nucleotide substitutions, 4 nucleotide insertions, and 1 nucleotide deletion, leading to a total of 8 possible mutations per nucleotide.

In some embodiments, DME library design comprises enumerating all possible mutations for each of one or more target monomers in a biomolecule. As used herein, a "target monomer" refers to a monomer in a biomolecule polymer that is targeted for DME with the substitutions, insertions and deletions described herein. For example, a target monomer can be an amino acid at a specified position in a protein, or a nucleotide at a specified position in an RNA. A biomolecule can have at least 1, 2, 3, 4, 5, 6, 7, 8, 9, 10, 20, 30, 40, 50, 100 or more target monomers that are systematically mutated to produce a DME library of biomolecule variants. In some embodiments, every monomer in a biomolecule is a target monomer. For example, in DME of a protein where there are two target amino acids, DME library design comprises enumerating the 40 possible DME mutations at each of the two target amino acids. In a further example, in DME of an RNA where there are four target nucleotides, DME library design comprises enumerating the 8 possible DME mutations at each of the four target nucleotides. In some embodiments, each target monomer of a biomolecule is independently randomly selected or selected by intentional design. Thus, in some embodiments, a DME library comprises random variants, or variants that were designed, or variants comprising random mutations and designed mutations within a single biomolecule, or any combinations thereof.

In some embodiments of DME methods, DME mutations are incorporated into double-stranded DNA encoding the biomolecule. This DNA can be maintained and replicated in a standard cloning vector, for example a bacterial plasmid, referred to herein as the target plasmid. An exemplary target plasmid contains a DNA sequence encoding the starting biomolecule that will be subjected to DME, a bacterial origin of replication, and a suitable antibiotic resistance expression cassette. In some embodiments, the antibiotic resistance cassette confers resistance to kanamycin, ampicillin, spectinomycin, bleomycin, streptomycin, erythromycin, tetracycline or chloramphenicol. In some embodiments, the antibiotic resistance cassette confers resistance to kanamycin.

A library comprising said variants can be constructed in a variety of ways. In certain embodiments, plasmid recombineering is used to construct a library. Such methods can use DNA oligonucleotides encoding one or more mutations to incorporate said mutations into a plasmid encoding the reference biomolecule. For biomolecule variants with a plurality of mutations, in some embodiments more than one oligonucleotide is used. In some embodiments, the DNA oligonucleotides encoding one or more mutations wherein the mutation region is flanked by between 10 and 100 nucleotides of homology to the target plasmid, both 5' and 3' to the mutation. Such oligonucleotides can in some embodiments be commercially synthesized and used in PCR amplification. An exemplary template for an oligonucleotide encoding a mutation is provided below:

5'-(N)$_{10-100}$-Mutation-(N')$_{10-100}$-3'

In this exemplary oligonucleotide design, the Ns represent a sequence identical to the target plasmid, referred to herein as the homology arms. When a particular monomer in the biomolecule is targeted for mutation, these homology arms directly flank the DNA encoding the monomer in the target plasmid. In some exemplary embodiments where the biomolecule undergoing DME is a protein, 40 different oligonucleotides, using the same set of homology arms, are used to encode the enumerated 40 different amino acid mutations for each amino acid residue in the protein that is targeted for DME. When the mutation is of a single amino acid, the region encoding the desired mutation or mutations comprises three nucleotides encoding an amino acid (for substitutions or single insertions), or zero nucleotides (for deletions). In some embodiments, the oligonucleotide encodes insertion of greater than one amino acid. For example, wherein the oligonucleotide encodes the insertion of X amino acids, the region encoding the desired mutation comprises 3*X nucleotides encoding the X amino acids. In some embodiments, the mutation region encodes more than one mutation, for example mutations to two or more monomers of a biomolecule that are in close proximity (e.g., next to each other, or within 1, 2, 3, 4, 5, 6, 7, 8, 9, or 10, or more monomers of each other).

In some exemplary embodiments where the biomolecule undergoing DME is an RNA, 8 different oligonucleotides, using the same set of homology arms, encode 8 different single nucleotide mutations for each nucleotide in the RNA that is targeted for DME. When the mutation is of a single ribonucleotide, the region of the oligo encoding the mutations can consist of the following nucleotide sequences: one nucleotide specifying a nucleotide (for substitutions or insertions), or zero nucleotides (for deletions). In some embodiments, the oligonucleotides are synthesized as single stranded DNA oligonucleotides. In some embodiments, all oligonucleotides targeting a particular amino acid or nucleotide of a biomolecule subjected to DME are pooled. In some embodiments, all oligonucleotides targeting a biomolecule subjected to DME are pooled. There is no limit to the type or number of mutations that can be created simultaneously in a DME library.

c. Library Screening

Any appropriate method for screening or selecting a DME library is envisaged as following within the scope of the inventions. High throughput methods may be used to evaluate large libraries with thousands of individual mutations. In some embodiments, the throughput of the library screening or selection assay has a throughput that is in the millions of individual cells. In some embodiments, assays utilizing living cells are preferred, because phenotype and genotype are physically linked in living cells by nature of being contained within the same lipid bilayer. Living cells can also be used to directly amplify sub-populations of the overall library. In other embodiments, smaller assays are used in DME methods, for example to screen a focused library developed through multiple rounds of mutation and evaluation. Exemplary methods of screening libraries are described in Examples 14 and 15.

In some embodiments, DME libraries that have been screened or selected for highly functional variants are further characterized. In some embodiments, further characterizing the DME library comprises analyzing DME variants individually through sequencing, such as Sanger sequencing, to identify the specific mutation or mutations that gave rise to the highly functional variant. Individual mutant variants of the biomolecule can be isolated through standard molecular biology techniques for later analysis of function. In some embodiments, further characterizing the DME library comprises high throughput sequencing of both the I library and the one or more libraries of highly functional variants. This approach may, in some embodiments, allow for the rapid identification of mutations that are overrepresented in the one or more libraries of highly functional variants compared to the naïve DME library. Without wishing to be bound by any theory, mutations that are overrepresented in the one or more libraries of highly functional variants are likely to be responsible for the activity of the highly functional variants. In some embodiments, further characterizing the DME library comprises both sequencing of individual variants and high throughput sequencing of bothlnaive library and the one or more libraries of highly functional variants.

High throughput sequencing can produce high throughput data indicating the functional effect of the library members. In embodiments wherein one or more libraries represents every possible mutation of every monomer location, such high throughput sequencing can evaluate the functional effect of every possible DME mutation. Such sequencing can also be used to evaluate one or more highly functional sub-populations of a given library, which in some embodiments may lead to identification of mutations that result in improved function. Deep Mutational Scanning In some embodiments, Deep Mutational Scanning (DMS) is used to identify CasX variant proteins with improved function. Deep mutational scanning assesses protein plasticity as it relates to function. In DMS methods, every amino acid of a protein is changed to every other amino acid and absolute protein function assayed. For example, every amino acid in a CasX protein can be changed to every other amino acid, and the mutated CasX proteins assayed for their ability to bind to or cleave DNA. Exemplary assays such as the CRISPRi assay or bacterial-based cleavage assays that can be used to characterize collections of DMS CasX variant proteins are described in Oakes et al. (2016) "Profiling of engineering hotspots identifies an allosteric CRISPR-Cas9 switch" Nat Biotechnol 34(6):646-51 and Liu et al. (2019) "CasX enzymes comprise a distinct family of RNA-guided genome editors" Nature doi.org/10.1038/s41586-019-0908; the contents of which are incorporated herein by reference.

In some embodiments, DMS is used to identify CasX proteins with improved DNA binding activity. In some embodiments, DNA binding activity is assayed using a CRISPRi assay. In a non-limiting, exemplary embodiment of a CRISPRi assay, cells expressing a fluorescent protein such as green fluorescent protein (GFP) or red fluorescent protein (RFP) are assayed using FACS to identify CasX variants capable of repressing expression of the fluorescent protein in a sgRNA dependent fashion. In this example, a catalytically-dead CasX (dCasX) is used to generate the collection of DMS mutants being assayed. The wild-type CasX protein binds to its cognate sgRNA and forms a protein-RNA complex. The complex binds to specific DNA targets by Watson-Crick base pairing between the sgRNA and the DNA target, in this case a DNA sequence encoding the fluorescent protein. In the case of wild-type CasX, the DNA will be cleaved due to the nuclease activity of the CasX protein. However, without wishing to be bound by theory, it is likely that dCasX is still able to form a complex with the sgRNA and bind to specific DNA target. When targeting of dCasX occurs to the protein-coding region, it blocks RNA polymerase II and transcript initiation and/or elongation, leading to a reduction in fluorescent protein expression that can be detected by FACs.

In some embodiments, DMS is used to identify CasX proteins with improved DNA cleavage activity. Methods of assaying the DNA cleavage efficiency of CasX variant proteins will be apparent to one of ordinary skill in the art. For example, CasX proteins complexed with an sgRNA with a spacer complementary to a particular target nucleic acid sequence can be used to cleave the DNA target sequence in vitro or in vivo in a suitable cell type, and the frequency of insertions and deletions at the site of cleavage are assayed. Without wishing to be bound by theory, cleavage or nicking by CasX generates double-strand breaks in DNA, whose subsequent repair by the non-homologous end joining pathway (NHEJ) gives rise to small insertions or deletions (indels) at the site of the double-strand breaks. The frequency of indels at the site of CasX cleavage can be measured using high throughput or Sanger sequencing of the target sequence. Alternatively, or in addition, frequency of indel generation by CasX cleavage of a target sequence can be measured using mismatch assays such as T7 Endonuclease I (T7EI) or Surveyor mismatch assays.

In some embodiments, following DMS, a map of the genotypes of DMS mutants linked with their resulting phenotype (for example, a heat map) is generated and used to characterize fundamental principles of the protein. All possible mutations are characterized as leading to functional or nonfunctional protein products to establish that protein's functional landscape.

d. Error Prone PCR

In some embodiments, Error Prone PCR is used to generate CasX protein or sgRNA scaffold variants with improved function. Polymerases that replicate DNA have different levels of fidelity. One way of introducing random mutations to a gene is through an error prone polymerase that will incorporate incorrect nucleotides at a range of frequencies. This frequency can be modulated depending on the desired outcome. In some embodiments, a polymerase and conditions for polymerase activity are selected that result in a frequency of nucleotide changes that produces an average of n 1-4 amino acid changes in a protein sequence. An exemplary error prone polymerase comprises Agilent's GeneMorphII kit. The GeneMorphII kit can be used to amplify a DNA sequence encoding a wild type CasX protein (for example, a protein of SEQ ID NO: 1, SEQ ID NO: 2 or SEQ ID NO: 3), according to the manufacturer's protocol, thereby subjecting the protein to unbiased random mutagenesis and generating a diverse population of CasX variant proteins. This diverse population of CasX variant proteins can then be assayed using the same assays described above for DMS to observe how changes in genotype relate to changes in phenotype.

e. Cassette Mutagenesis

In some embodiments, cassette mutagenesis is used to generate CasX variant protein or sgRNA scaffold variants with improved function. Cassette mutagenesis takes advantage of unique restriction enzyme sites that are replaced by degenerative nucleotides to create small regions of high diversity in select areas of a gene of interest such as a CasX protein or sgRNA scaffold. In an exemplary cassette mutagenesis protocol, restriction enzymes are used to cleave near the sequence targeted for mutagenesis on DNA molecule encoding a CasX protein or sgRNA scaffold contained in a suitable vector. This step removes the sequence targeted for mutagenesis and everything between the restriction sites. Then, synthetic double stranded DNA molecules containing the desired mutation and ends that are complimentary to the restriction digest ends are ligated in place of the sequence that has been removed by restriction digest, and suitable cells, such as *E. coli* are transformed with the ligated vector. In some embodiments, cassette mutagenesis can be used to generate one or more specific mutations in a CasX protein or sgRNA scaffold. In some embodiments, cassette mutagenesis can be used to generate a library of CasX variant proteins or sgRNA scaffold variants that can be screened or selected for improved function using the methods described herein. For example, in using cassette mutagenesis to generate CasX variants, parts of the Non-Target Strand Binding (NTSB) domain can be replaced with a sequence of degenerate nucleotides. Sequences of degenerate nucleotides can be highly localized to regions of the CasX protein, for example regions of the NTSB that are of interest because of their highly mobile elements or their direct contacts with DNA. Libraries of CasX variant proteins generated via cassette mutagenesis can then be screened using the assays described herein for DME, DMS and error prone PCR and variants can be selected for improved function.

f. Random Mutagenesis

In some embodiments, random mutagenesis is used to generate CasX variant proteins or sgRNA scaffold variants with improved function. Random mutagenesis is an unbiased way of changing DNA. Exemplary methods of random mutagenesis will be known to the person of ordinary skill in the art and include exposure to chemicals, UV light, X-rays or use of unstable cell lines. Different mutagenic agents produce different types of mutations, and the ordinarily skilled artisan will be able to select the appropriate agent to generate the desired type of mutations. For example, ethylmethanesulfonate (EMS) and N-ethyl-N-nitrosourea (ENU) can be used to generate single base pair changes, while X-rays often result in deletions and gross chromosomal rearrangements. UV light exposure produces dimers between adjacent pyrimidines in DNA, which can result in point mutations, deletions and rearrangements. Error prone cell lines can also be used to introduce mutations, for example on a plasmid comprising a CasX protein or sgRNA scaffold of the disclosure. A population of DNA molecules encoding a CasX protein (for example, a protein of SEQ ID NO: 1, SEQ ID NO: 2 or SEQ ID NO: 3) or an sgRNA scaffold can be exposed to a mutagen to generate collection of CasX variant proteins or sgRNA scaffold variants, and these collections can be assayed for improved function using any of the assays described herein.

g. Staggered Extension Process (StEP)

In some embodiments, a staggered extension process (StEP) is used to generate CasX variant proteins or sgRNA scaffold variants with improved function. Staggered extension process is a specialized PCR protocol that allows for the breeding of multiple variants of a protein during a PCR reaction. StEP utilizes a polymerase with low processivity, (for example Taq or Vent polymerase) to create short primers off of two or more different template strands with a significant level of sequence similarity. The short primers are then extended for short time intervals allowing for shuffling of the template strands. This method can also be used as a means to stack DME variants. Exemplary StEP protocols are described by Zhao, H. et al. (1998) "Molecular evolution by staggered extension process (StEP) in vitro recombination" Nature Biotechnology 16: 258-261, the contents of which are incorporated herein by reference in their entirety. StEP can be used to generate collections of CasX variant proteins or sgRNA scaffold variants, and these collections can be assayed for improved function using any of the assays described herein.

h. Gene Shuffling

In some embodiments, gene shuffling is used to generate CasX variant proteins or sgRNA scaffold variants with improved function. In some embodiments, gene shuffling is used to combine (sometimes referred to herein as "stack") variants produced through other methods described herein, such as plasmid recombineering. In an exemplary gene shuffling protocol, a DNase, for example DNase I, is used to shear a set of parent genes into pieces of 50-100 base pair (bp) in length. In some embodiments, these parent genes comprise CasX variant proteins with improved function created and isolated using the methods described herein. In some embodiments, these parent genes comprise sgRNA scaffold variants with improved function created and isolated using the methods described herein. Dnase fragmentation is then followed by a polymerase chain reaction (PCR) without primers. DNA fragments with sufficient overlapping homologous sequence will anneal to each other and are then extended by DNA polymerase. If different fragments comprising different mutations anneal, the result is a new variant combining those two mutations. In some embodiments, PCR without primers is followed by PCR extension, and purification of shuffled DNA molecules that have reached the size of the parental genes (e.g., a sequence encoding a CasX protein or sgRNA scaffold). These genes can then be amplified with another PCR, for example by adding PCR primers complementary to the 5' and 3' ends of gene undergoing shuffling. In some embodiments, the primers may have additional sequences added to their 5' ends, such as sequences for restriction enzyme recognition sites needed for ligation into a cloning vector.

i. Domain Swapping

In some embodiments, domain swapping is used to generate CasX variant proteins or sgRNA scaffold variants with improved function. To generate CasX variant proteins, engineered domain swapping can be used to mix and match parts with other proteins and CRISPR molecules. For example, CRISPR proteins have conserved RuvC domains, so the CasX RuvC domain could be swapped for that of other CRISPR proteins, and the resulting protein assayed for improved DNA cleavage using the assays described herein. For sgRNAs, the scaffold stem, extended stem or loops can be exchanged with structures found in other RNAs, for example the scaffold stem and extended stem of the sgRNA can be exchanged with thermostable stem loops from other RNAs, and the resulting variant assayed for improved function using the assays described herein. In some embodiments, domain swapping can be used to insert new domains into the CasX protein or sgRNA. In some exemplary embodiments where domain swapping is applied to a protein, the inserted domain comprises an entire second protein.

j. Production of CasX and gRNA Variants

A CasX variant protein of the present disclosure may be produced in vitro by eukaryotic cells or by prokaryotic cells transformed with encoding vectors (described below) using standard cloning and molecularly biology techniques or as described in the Examples. The particular sequence and the manner of preparation will be determined by convenience, economics, purity required, and the like. In some embodiments, a construct is first prepared containing the DNA sequence encoding the CasX variant. Exemplary methods for the preparation of such constructs are described in the Examples. In some embodiments, the nucleotide sequence encoding a CasX protein is codon optimized for the intended host cell. The construct is then used to create an expression vector suitable for transforming a host cell, such as a prokaryotic or eukaryotic host cell for the expression and recovery of the protein. Where desired, the host cell is an *E. coli*. In other embodiments, the host cell is a eukaryotic cell. The eukaryotic host cell can be selected from Baby Hamster Kidney fibroblast (BHK) cells, human embryonic kidney 293 (HEK293), human embryonic kidney 293T (HEK293T), NS0 cells, SP2/0 cells, YO myeloma cells, P3X63 mouse myeloma cells, PER cells, PER.C6 cells, hybridoma cells, NIH3T3 cells, CV-1 (simian) in Origin with SV40 genetic material (COS), HeLa, Chinese hamster ovary (CHO), or yeast cells, or other eukaryotic cells known in the art suitable for the production of recombinant products.

If desired, various groups may be introduced into the sequence during synthesis or during expression, which allow for linking to other molecules or to a surface. Thus, cysteines can be used to make thioethers, histidines for linking to a metal ion complex, carboxyl groups for forming amides or esters, amino groups for forming amides, and the like. A CasX variant protein of the disclosure may also be isolated and purified in accordance with conventional methods of recombinant synthesis. A lysate may be prepared of the expression host and the lysate purified using high performance liquid chromatography (HPLC), exclusion chromatography, gel electrophoresis, affinity chromatography, or other purification technique. For the most part, the compositions which are used will comprise 80% or more by weight of the desired product, more usually 90% or more by weight, preferably 95% or more by weight, and for therapeutic purposes, usually 99.5% or more by weight, in relation to contaminants related to the method of preparation of the product and its purification.

In the case of production of the gRNA of the present disclosure, recombinant expression vectors encoding the gRNA can be transcribed in vitro, for example using T7 promoter regulatory sequences and T7 polymerase in order to produce the gRNA, which can then be recovered by conventional methods; e.g., purification via gel electrophoresis as described in the Examples. Once synthesized, the gRNA may be utilized in the gene editing pair to directly contact a target nucleic acid or may be introduced into a cell by any of the well-known techniques for introducing nucleic acids into cells (e.g., microinjection, electroporation, transfection, etc.).

VI. Polynucleotides and Vectors

In another aspect, the present disclosure relates to polynucleotides encoding the Class 2, Type V nucleases and gRNA that have utility in the editing of the target nucleic acid in a cell. In some embodiments, the disclosure provides polynucleotides encoding the CasX proteins and the polynucleotides of the gRNAs of any of the CasX:gRNA system embodiments described herein.

In some embodiments, the disclosure provides a polynucleotide sequence encoding the CasX variants of any of the embodiments described herein, including the CasX protein variants of SEQ ID NOS: 247-592 or 1147-1231 as described in Table 3 or sequences having at least about 50%, at least about 60%, at least about 70%, at least about 80%, at least about 90%, at least about 95%, at least about 96%, at least about 97%, at least about 98%, or at least about 99% sequence identity to a sequence of SEQ ID NOS: 247-592 and 1147-1231 of Table 3. In some embodiments, the disclosure provides a polynucleotide sequence encoding a CasX variant of any of SEQ ID NOS: 270-592 or 1147-1231 or a sequence having at least about 50%, at least about 60%, at least about 70%, at least about 80%, at least about 90%, at least about 95%, at least about 96%, at least about 97%, at least about 98%, or at least about 99% sequence identity thereto. In some embodiments, the disclosure provides a polynucleotide sequence encoding a CasX variant of any of SEQ ID NOS: 415-592 or 1147-1231 or a sequence having at least about 50%, at least about 60%, at least about 70%, at least about 80%, at least about 90%, at least about 95%, at least about 96%, at least about 97%, at least about 98%, or at least about 99% sequence identity thereto. In some embodiments, the disclosure provides an isolated polynucleotide sequence encoding a gRNA variant sequence of any of the embodiments described herein, including the sequences of SEQ ID NOS: 2101-2332 and 2353-2398 of Table 2, together with targeting sequences capable of hybridizing with the target nucleic acid to be modified. In some embodiments, the disclosure provides an isolated polynucleotide sequence encoding a gRNA variant sequence of any one of SEQ ID NOS: 2238-2332 or 2353-2398, together with targeting sequences capable of hybridizing with the target nucleic acid to be modified. In some embodiments, the disclosure provides an isolated polynucleotide sequence encoding a gRNA variant sequence of any one of SEQ ID NOS: 2281-2332 or 2353-2398, together with targeting sequences capable of hybridizing with the target nucleic acid to be modified.

In some embodiments, the disclosure provides donor template polynucleotides encoding portions or all of a gene to be modified. In some embodiments, the donor template is intended for gene editing in conjunction with the CasX:gRNA system and comprises at least a portion of the gene to be modified. In other embodiments, the donor sequence comprises a sequence that encodes at least a portion of an exon of the gene to be modified. In other embodiments, the donor template has a sequence that encodes at least a portion of an intron of the gene to be modified. In other embodiments, the donor template has a sequence that encodes at least a portion of an intron-exon junction of the gene to be modified. In other embodiments, the donor template has a sequence that encodes at least a portion of an intergenic region of the gene to be modified. In other embodiments, the donor template has a sequence that encodes at least a portion of a regulatory element of the gene to be modified. In some cases, the donor template is a wild-type sequence that encodes at least a portion of the gene to be modified. In other cases, the donor template sequence comprises one or more mutations relative to a wild-type gene to be knocked down or knocked out. In such cases, the donor template would have at least 1 to 5 or more mutations relative to the wild-type sequence. In the foregoing embodiments, the donor template is at least 10 nucleotides, at least 100 nucleotides, at least 200 nucleotides, at least 300 nucleotides, at least 400 nucleotides, at least 500 nucleotides, at least 600 nucleotides, at least 700 nucleotides, at least 800 nucleotides, at least 900 nucleotides, at least 1,000 nucleotides, at least 2,000 nucleotides, at least 3,000 nucleotides, at least 4,000 nucleotides, at least 5,000 nucleotides, at least 6,000 nucleotides, at least 7,000 nucleotides, at least 8,000 nucleotides, at least 9,000 nucleotides, at least 10,000 nucleotides, at least 12,000 nucleotides, or at least 15,000 nucleotides. In some embodiments, the donor template comprises at least about 10 to about 15,000 nucleotides. In some embodiments, the donor template is a single-stranded DNA template. In other embodiments, the donor template is a single stranded RNA template. In other embodiments, the donor template is a double-stranded DNA template. In some embodiments, the donor template can be provided as naked nucleic acid in the systems to edit the gene and does not need to be incorporated into a vector. In other embodiments, the donor template can be incorporated into a vector to facilitate its delivery to a cell; e.g., in a viral vector.

In other aspects, the disclosure relates to methods to produce polynucleotide sequences encoding the CasX variants, or the gRNA of any of the embodiments described herein, including homologous variants thereof, as well as methods to express the proteins expressed or RNA transcribed by the polynucleotide sequences. In general, the methods include producing a polynucleotide sequence coding for the CasX variants, or the gRNA of any of the embodiments described herein and incorporating the encoding gene into an expression vector appropriate for a host cell. Standard recombinant techniques in molecular biology can be used to make the polynucleotides and expression vectors of the present disclosure. For production of the encoded reference CasX, the CasX variants, or the gRNA of any of the embodiments described herein, the methods include transforming an appropriate host cell with an expression vector comprising the encoding polynucleotide, and culturing the host cell under conditions causing or permitting the resulting reference CasX, the CasX variants, or the gRNA of any of the embodiments described herein to be expressed or transcribed in the transformed host cell, thereby producing the CasX variants, or the gRNA, which are recovered by methods described herein or by standard purification methods known in the art or as described in the Examples In accordance with the disclosure, nucleic acid sequences that encode the CasX variants, or the gRNA of any of the embodiments described herein (or their complement) are used to generate recombinant DNA molecules that direct the expression in appropriate host cells. Several cloning strategies are suitable for performing the present disclosure, many of which are used to generate a construct that comprises a gene coding for a composition of the present disclosure, or its complement. In some embodiments, the cloning strategy is used to create a gene that encodes a construct that comprises nucleotides encoding the CasX variants or the gRNA that is used to transform a host cell for expression of the composition.

In some approaches, a construct is first prepared containing the DNA sequence encoding a CasX variant or a gRNA. Exemplary methods for the preparation of such constructs are described in the Examples. The construct is then used to create an expression vector suitable for transforming a host cell, such as a prokaryotic or eukaryotic host cell for the expression and recovery of the protein construct, in the case of the CasX, or the gRNA. Where desired, the host cell is an E. coli. In other embodiments, the host cell is a eukaryotic cell. The eukaryotic host cell can be selected from Baby Hamster Kidney fibroblast (BHK) cells, human embryonic kidney 293 (HEK293), human embryonic kidney 293T (HEK293T), NS0 cells, SP2/0 cells, YO myeloma cells, P3X63 mouse myeloma cells, PER cells, PER.C6 cells, hybridoma cells, NIH3T3 cells, CV-1 (simian) in Origin with SV40 genetic material (COS), HeLa, Chinese hamster ovary (CHO), or yeast cells, or other eukaryotic cells known in the art suitable for the production of recombinant products. Exemplary methods for the creation of expression vectors, the transformation of host cells and the expression and recovery of the CasX variants or the gRNA are described in the Examples.

The gene encoding the CasX variant, or the gRNA construct can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate sequences of polynucleotides encoding the various components (e.g., CasX and gRNA) genes of a desired sequence. Genes encoding polypeptide compositions are assembled from oligonucleotides using standard techniques of gene synthesis.

In some embodiments, the nucleotide sequence encoding a CasX protein is codon optimized for the intended host cell. This type of optimization can entail a mutation of an encoding nucleotide sequence to mimic the codon preferences of the intended host organism or cell while encoding the same CasX protein. Thus, the codons can be changed, but the encoded protein or gRNA remains unchanged. For example, if the intended target cell of the CasX protein was a human cell, a human codon-optimized CasX-encoding nucleotide sequence could be used. As another non-limiting example, if the intended host cell were a mouse cell, then a mouse codon-optimized CasX-encoding nucleotide sequence could be generated. The gene design can be performed using algorithms that optimize codon usage and amino acid composition appropriate for the host cell utilized in the production of the reference CasX or the CasX variants. In one method of the disclosure, a library of polynucleotides encoding the components of the constructs is created and then assembled, as described above. The resulting genes are then assembled, and the resulting genes used to transform a host cell and produce and recover the CasX variants, or the gRNA compositions for evaluation of its properties, as described herein.

The disclosure provides for the use of plasmid expression vectors containing replication and control sequences that are compatible with and recognized by the host cell and are operably linked to the gene encoding the polypeptide for controlled expression of the polypeptide or transcription of the RNA. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the polypeptide in a suitable host. The requirements are that the vectors are replicable and viable in the host cell of choice. Low- or high-copy number vectors may be used as desired. The control sequences of the vector include a promoter to effect transcription, an optional operator sequence to control such transcription, a sequence encoding suitable mRNA ribosome binding sites, and sequences that control termination of transcription and translation. In some embodiments, a nucleotide sequence encoding a gRNA is operably linked to a control element, e.g., a transcriptional control element, such as a promoter. In some embodiments, a nucleotide sequence encoding a CasX protein is operably linked to a control element, e.g., a transcriptional control element, such as a promoter. In other cases, the nucleotide encoding the CasX and gRNA are linked and are operably linked to a single control element. The promoter may be any DNA sequence, which shows transcriptional activity in the host cell of choice and may be derived from genes encoding proteins either homologous or heterologous to the host cell. Exemplary regulatory elements include a transcription promoter, a transcription enhancer element, a transcription termination signal, internal ribosome entry site (IRES) or P2A peptide to permit translation of multiple genes from a single transcript, polyadenylation sequences to promote downstream transcriptional termination, sequences for optimization of initiation of translation, and translation termination sequences. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells, e.g., packaging cells for viral or XDP vectors, hematopoietic stem cells (HSC), hematopoietic progenitor cells (HPC), CD34+ cells, mesenchymal stem cells (MSC), embryonic stem (ES) cells, induced pluripotent stem cells (iPSC), common myeloid progenitor cells, proerythroblast cells, and erythroblast cells.

Non-limiting examples of pol II promoters include, but are not limited to EF-1alpha, EF-1alpha core promoter, Jens Tornoe (JeT), promoters from cytomegalovirus (CMV), CMV immediate early (CMVIE), CMV enhancer, herpes simplex virus (HSV) thymidine kinase, early and late simian virus 40 (SV40), the SV40 enhancer, long terminal repeats (LTRs) from retrovirus, mouse metallothionein-I, adenovirus major late promoter (Ad MLP), CMV promoter full-length promoter, the minimal CMV promoter, the chicken (Eε-actin promoter (CBA), CBA hybrid (CBh), chicken (Eε-actin promoter with cytomegalovirus enhancer (CB7), chicken beta-Actin promoter and rabbit beta-Globin splice acceptor site fusion (CAG), the rous sarcoma virus (RSV) promoter, the HIV-Ltr promoter, the hPGK promoter, the HSV TK promoter, a 7SK promoter, the Mini-TK promoter, the human synapsin I (SYN) promoter which confers neuron-specific expression, beta-actin promoter, super core promoter 1 (SCP1), the Mecp2 promoter for selective expression in neurons, the minimal IL-2 promoter, the Rous sarcoma virus enhancer/promoter (single), the spleen focus-forming virus long terminal repeat (LTR) promoter, the TBG promoter, promoter from the human thyroxine-binding globulin gene (Liver specific), the PGK promoter, the human ubiquitin C promoter (UBC), the UCOE promoter (Promoter of HNRPA2B1-CBX3), the synthetic CAG promoter, the Histone H2 promoter, the Histone H3 promoter, the U1a1 small nuclear RNA promoter (226 nt), the U1a1 small nuclear RNA promoter (226 nt), the U1b2 small nuclear RNA promoter (246 nt) 26, the GUSB promoter, the CBh promoter, rhodopsin (Rho) promoter, silencing-prone spleen focus forming virus (SFFV) promoter, a human H1 promoter (H1), a POL1 promoter, the TTR minimal enhancer/promoter, the b-kinesin promoter, mouse mammary tumor virus long terminal repeat (LTR) promoter, the human eukaryotic initiation factor 4A (EIF4A1) promoter, the ROSA26 promoter, the glyceraldehyde 3-phosphate dehydrogenase (GAPDH) promoter, tRNA promoters, and truncated versions and sequence variants of the foregoing. In a particular embodiment, the pol II promoter is EF-1alpha, wherein the promoter enhances transfection efficiency, the transgene transcription or expression of the CRISPR nuclease, the proportion of expression-positive clones and the copy number of the episomal vector in long-term culture.

Non-limiting examples of pol III promoters include, but are not limited to U6, mini U6, U6 truncated promoters, 7SK, and H1 variants, BiH1 (Bidrectional H1 promoter), BiU6, Bi7SK, BiH1 (Bidirectional U6, 7SK, and H1 promoters), gorilla U6, rhesus U6, human 7SK, human H1 promoters, and sequence variants thereof. In the foregoing embodiment, the pol III promoter enhances the transcription of the gRNA.

Selection of the appropriate vector and promoter is well within the level of ordinary skill in the art, as it related to controlling expression, e.g., for modifying a gene. The expression vector may also contain a ribosome binding site for translation initiation and a transcription terminator. The expression vector may also include appropriate sequences for amplifying expression. The expression vector may also include nucleotide sequences encoding protein tags (e.g., 6×His tag, hemagglutinin tag, fluorescent protein, etc.) that can be fused to the CasX protein, thus resulting in a chimeric CasX protein that are used for purification or detection.

Recombinant expression vectors of the disclosure can also comprise elements that facilitate robust expression of CasX proteins and the gRNAs of the disclosure. For example, recombinant expression vectors can include one or more of a polyadenylation signal (poly(A)), an intronic sequence or a post-transcriptional regulatory element such as a woodchuck hepatitis post-transcriptional regulatory element (WPRE). Exemplary poly(A) sequences include hGH poly (A) signal (short), HSV TK poly(A) signal, synthetic polyadenylation signals, SV40 poly(A) signal, β-globin poly(A) signal and the like. A person of ordinary skill in the art will be able to select suitable elements to include in the recombinant expression vectors described herein.

In some embodiments, provided herein are one or more recombinant expression vectors comprising one or more of: (i) a nucleotide sequence of a donor template nucleic acid where the donor template comprises a nucleotide sequence having homology to a sequence of the target locus of the target nucleic acid (e.g., a target genome); (ii) a nucleotide sequence that encodes a gRNA that hybridizes to a target sequence of the locus of the targeted genome (e.g., configured as a single or dual guide RNA) operably linked to a promoter that is operable in a target cell such as a eukaryotic cell; and (iii) a nucleotide sequence encoding a CasX protein operably linked to a promoter that is operable in a target cell such as a eukaryotic cell. In some embodiments, the sequences encoding the donor template, the gRNA and the CasX protein are in different recombinant expression vectors, and in other embodiments one or more polynucleotide sequences (for the donor template, CasX, and the gRNA) are in the same recombinant expression vector.

The polynucleotide sequence(s) are inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated. Once introduced into a suitable host cell, expression of the protein involved in antigen processing, antigen presentation, antigen recognition, and/or antigen response can be determined using any nucleic acid or protein assay known in the art. For example, the presence of transcribed mRNA of reference CasX or the CasX variants can be detected and/or quantified by conventional hybridization assays (e.g., Northern blot analysis), amplification procedures (e.g. RT-PCR), SAGE (U.S. Pat. No. 5,695,937), and array-based technologies (see e.g., U.S. Pat. Nos. 5,405, 783, 5,412,087 and 5,445,934), using probes complementary to any region of the polynucleotide.

The polynucleotides and recombinant expression vectors can be delivered to the target host cells by a variety of methods. Such methods include, but are not limited to, viral infection, transfection, lipofection, electroporation, calcium phosphate precipitation, polyethyleneimine (PEI)-mediated transfection, DEAE-dextran mediated transfection, microinjection, liposome-mediated transfection, particle gun technology, nucleofection, direct addition by cell penetrating CasX proteins that are fused to or recruit donor DNA, cell squeezing, calcium phosphate precipitation, direct microinjection, nanoparticle-mediated nucleic acid delivery, and using the commercially available TransMessenger® reagents from Qiagen, Stemfect™ RNA Transfection Kit from Stemgent, and TransIT®-mRNA Transfection Kit from Mirus Bio LLC, Lonza nucleofection, Maxagen electroporation and the like.

A recombinant expression vector sequence can be packaged into a virus or virus-like particle (also referred to herein as a "particle" or "virion") for subsequent infection and transformation of a cell, ex vivo, in vitro or in vivo. Such particles or virions will typically include proteins that encapsidate or package the vector genome. Suitable expression vectors may include viral expression vectors based on vaccinia virus; poliovirus; adenovirus; a retroviral vector (e.g., Murine Leukemia Virus), spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus; and the like. In some embodiments, a recombinant expression vector of the present disclosure is a recombinant adeno-associated virus (AAV) vector. In some embodiments, a recombinant expression vector of the present disclosure is a recombinant lentivirus vector. In some embodiments, a recombinant expression vector of the present disclosure is a recombinant retroviral vector.

In some embodiments, a recombinant expression vector of the present disclosure is a recombinant adeno-associated virus (AAV) vector. In some embodiments, a recombinant expression vector of the present disclosure is a recombinant lentivirus vector. In some embodiments, a recombinant expression vector of the present disclosure is a recombinant retroviral vector.

AAV is a small (20 nm), nonpathogenic virus that is useful in treating human diseases in situations that employ a viral vector for delivery to a cell such as a eukaryotic cell, either in vivo or ex vivo for cells to be prepared for administering to a subject. A construct is generated, for example a construct encoding any of the CasX proteins and/or CasX gRNA embodiments as described herein, and is flanked with AAV inverted terminal repeat (ITR) sequences, thereby enabling packaging of the AAV vector into an AAV viral particle.

An "AAV" vector may refer to the naturally occurring wild-type virus itself or derivatives thereof. The term covers all subtypes, serotypes and pseudotypes, and both naturally occurring and recombinant forms, except where required otherwise. As used herein, the term "serotype" refers to an AAV which is identified by and distinguished from other AAVs based on capsid protein reactivity with defined antisera, e.g., there are many known serotypes of primate AAVs. In some embodiments, the AAV vector is selected from AAV1, AAV2, AAV3, AAV4, AAV5, AAV6, AAV7, AAV8, AAV9, AAV10, AAV11, AAV12, AAV 44.9, AAV-Rh74 (Rhesus macaque-derived AAV), and AAVRh10, and modified capsids of these serotypes. For example, serotype AAV-2 is used to refer to an AAV which contains capsid proteins encoded from the cap gene of AAV-2 and a genome containing 5' and 3' ITR sequences from the same AAV-2 serotype. Pseudotyped AAV refers to an AAV that contains capsid proteins from one serotype and a viral genome including 5'-3' ITRs of a second serotype. Pseudotyped rAAV would be expected to have cell surface binding properties of the capsid serotype and genetic properties consistent with the ITR serotype. Pseudotyped recombinant AAV (rAAV) are produced using standard techniques described in the art. As used herein, for example, rAAV1 may be used to refer an AAV having both capsid proteins and 5'-3' ITRs from the same serotype or it may refer to an AAV having capsid proteins from serotype 1 and 5'-3' ITRs from a different AAV serotype, e.g., AAV serotype 2. For each example illustrated herein the description of the vector design and production describes the serotype of the capsid and 5'-3' ITR sequences.

An "AAV virus" or "AAV viral particle" refers to a viral particle composed of at least one AAV capsid protein (preferably by all of the capsid proteins of a wild-type AAV) and an encapsidated polynucleotide. If the particle additionally comprises a heterologous polynucleotide (i.e., a polynucleotide other than a wild-type AAV genome to be delivered to a mammalian cell), it is typically referred to as "rAAV". An exemplary heterologous polynucleotide is a polynucleotide comprising a CasX protein and/or sgRNA and, optionally, a donor template of any of the embodiments described herein.

By "adeno-associated virus inverted terminal repeats" or "AAV ITRs" is meant the art recognized regions found at each end of the AAV genome which function together in cis as origins of DNA replication and as packaging signals for the virus. AAV ITRs, together with the AAV rep coding region, provide for the efficient excision and rescue from, and integration of a nucleotide sequence interposed between two flanking ITRs into a mammalian cell genome.

The nucleotide sequences of AAV ITR regions are known. See, for example Kotin, R. M. (1994) Human Gene Therapy 5:793-801; Berns, K. I. "Parvoviridae and their Replication" in Fundamental Virology, $2^{nd}$ Edition, (B. N. Fields and D. M. Knipe, eds.). As used herein, an AAV ITR need not have the wild-type nucleotide sequence depicted, but may be altered, e.g., by the insertion, deletion or substitution of nucleotides. Additionally, the AAV ITR may be derived from any of several AAV serotypes, including without limitation, AAV1, AAV2, AAV3, AAV4, AAV5, AAV6, AAV7, AAV8, AAV9, AAV10, AAV-Rh74, and AAVRh10, and modified capsids of these serotypes. Furthermore, 5' and 3' ITRs which flank a selected nucleotide sequence in an AAV vector need not necessarily be identical or derived from the same AAV serotype or isolate, so long as they function as intended, i.e., to allow for excision and rescue of the sequence of interest from a host cell genome or vector, and to allow integration of the heterologous sequence into the recipient cell genome when AAV Rep gene products are present in the cell. Use of AAV serotypes for integration of heterologous sequences into a host cell is known in the art (see, e.g., WO2018195555A1 and US20180258424A1, incorporated by reference herein.)

By "AAV rep coding region" is meant the region of the AAV genome which encodes the replication proteins Rep 78, Rep 68, Rep 52 and Rep 40. These Rep expression products have been shown to possess many functions, including recognition, binding and nicking of the AAV origin of DNA replication, DNA helicase activity and modulation of transcription from AAV (or other heterologous) promoters. The Rep expression products are collectively required for replicating the AAV genome. By "AAV cap coding region" is meant the region of the AAV genome which encodes the capsid proteins VP1, VP2, and VP3, or functional homologues thereof. These Cap expression products supply the packaging functions which are collectively required for packaging the viral genome.

In some embodiments, AAV capsids utilized for delivery of the encoding sequences for the CasX and gRNA, and, optionally, the DMPK donor template nucleotides to a host cell can be derived from any of several AAV serotypes, including without limitation, AAV1, AAV2, AAV3, AAV4, AAV5, AAV6, AAV7, AAV8, AAV9, AAV10, AAV11, AAV12, AAV 44.9, AAV-Rh74 (Rhesus macaque-derived AAV), and AAVRh10, and the AAV ITRs are derived from AAV serotype 2. In a particular embodiment, AAV1, AAV7, AAV6, AAV8, or AAV9 are utilized for delivery of the CasX, gRNA, and, optionally, donor template nucleotides, to a host muscle cell.

In order to produce rAAV viral particles, an AAV expression vector is introduced into a suitable host cell using known techniques, such as by transfection. Packaging cells are typically used to form virus particles; such cells include HEK293 cells (and other cells known in the art), which package adenovirus. A number of transfection techniques are generally known in the art; see, e.g., Sambrook et al. (1989) Molecular Cloning, a laboratory manual, Cold Spring Harbor Laboratories, New York. Particularly suitable transfection methods include calcium phosphate co-precipitation, direct microinjection into cultured cells, electroporation, liposome mediated gene transfer, lipid-mediated transduction, and nucleic acid delivery using high-velocity microprojectiles.

Figure 13:
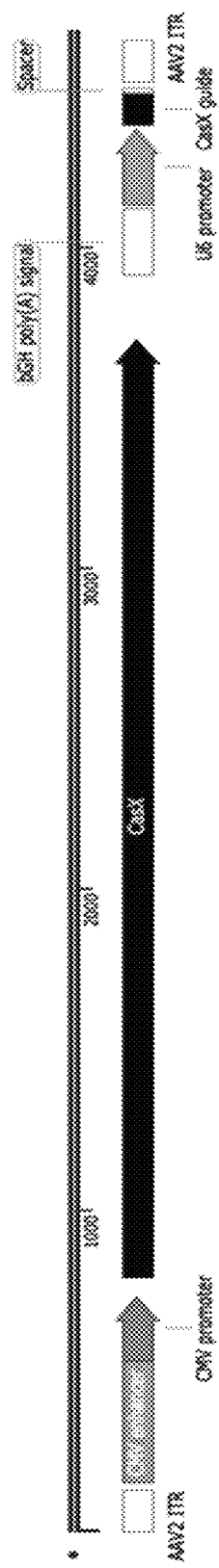
FIG. 13 is a schematic showing an example of CasX protein and scaffold DNA sequence for packaging in adeno-associated virus (AAV). The DNA segment between the AAV inverted terminal repeats (ITRs), comprised of a CasX-encoding DNA and its promoter, and scaffold-encoding DNA and its promoter gets packaged within an AAV capsid during AAV production.

In an advantage of rAAV constructs of the present disclosure, the smaller size of the Class 2, Type V CRISPR nucleases; e.g., the CasX variants of the embodiments, permits the inclusion of all the necessary editing and ancillary expression components into the transgene such that a single rAAV particle can deliver and transduce these components into a target cell in a form that results in the expression of the CRISPR nuclease and gRNA that are capable of effectively modifying the target nucleic acid of the target cell. A representative schematic of such a construct is presented in FIG. 13. This stands in marked contrast to other CRISPR systems, such as Cas9, where typically a two-particle system is employed to deliver the necessary editing components to a target cell. Thus, in some embodiments of the rAAV systems, the disclosure provides; i) a first plasmid comprising the ITRs, sequences encoding the CasX variant, sequences encoding one or more gRNA, a first promoter operably linked to the CasX and a second promoter operably linked to the gRNA, and, optionally, one or more enhancer elements; ii) a second plasmid comprising the rep and cap genes; and iii) a third plasmid comprising helper genes, wherein upon transfection of an appropriate packaging cell, the cell is capable of producing an rAAV having the ability to deliver to a target cell, in a single particle, sequences capable of expressing the CasX nuclease and gRNA having the ability to edit the target nucleic acid of the target cell. In some embodiments of the rAAV systems, the sequence encoding the CRISPR protein and the sequence encoding the at least first gRNA are less than about 3100, less than about 3090, less than about 3080, less than about 3070, less than about 3060, less than about 3050, or less than about 3040 nucleotides in length, such that the sequences encoding the first and second promoter and, optionally, one or more enhance elements can have at least about 1300, at least about 1350, at least about 1360, at least about 1370, at least about 1380, at least about 1390, at least about 1400, at least about 1500, at least about 1600 nucleotides, at least 1650, at least about 1700, at least about 1750, at least about 1800, at least about 1850, or at least about 1900 nucleotides in combined length. In some embodiments of the rAAV systems, the sequence encoding the first promoter and the at least one accessory element have greater than at least about 1300, at least about 1350, at least about 1360, at least about 1370, at least about 1380, at least about 1390, at least about 1400, at least about 1500, at least about 1600 nucleotides, at least 1650, at least about 1700, at least about 1750, at least about 1800, at least about 1850, or at least about 1900 nucleotides in combined length. In some embodiments of the rAAV systems, the sequence encoding the first and second promoters and the at least one accessory element have greater than at least about 1300, at least about 1350, at least about 1360, at least about 1370, at least about 1380, at least about 1390, at least about 1400, at least about 1500, at least about 1600 nucleotides, at least 1650, at least about 1700, at least about 1750, at least about 1800, at least about 1850, or at least about 1900 nucleotides in combined length.

In some embodiments, host cells transfected with the above-described AAV expression vectors are rendered capable of providing AAV helper functions in order to replicate and encapsidate the nucleotide sequences flanked by the AAV ITRs to produce rAAV viral particles. AAV helper functions are generally AAV-derived coding sequences which can be expressed to provide AAV gene products that, in turn, function in trans for productive AAV replication. AAV helper functions are used herein to complement necessary AAV functions that are missing from the AAV expression vectors. Thus, AAV helper functions include one, or both of the major AAV ORFs (open reading frames), encoding the rep and cap coding regions, or functional homologues thereof. Accessory functions can be introduced into and then expressed in host cells using methods known to those of skill in the art. Commonly, accessory functions are provided by infection of the host cells with an unrelated helper virus. In some embodiments, accessory functions are provided using an accessory function vector. Depending on the host/vector system utilized, any of a number of suitable transcription and translation control elements, including constitutive and inducible promoters, transcription enhancer elements, transcription terminators, etc., may be used in the expression vector. In some embodiments, the disclosure provides host cells comprising the AAV vectors of the embodiments disclosed herein.

In other embodiments, suitable vectors may include virus-like particles (VLP). Virus-like particles (VLPs) are particles that closely resemble viruses, but do not contain viral genetic material and are therefore non-infectious. In some embodiments, VLPs comprise a polynucleotide encoding a transgene of interest, for example any of the CasX protein and/or a gRNA embodiments, and, optionally, donor template polynucleotides described herein, packaged with one or more viral structural proteins.

In other embodiments, the disclosure provides CasX delivery particles (XDPs) produced in vitro that comprise a CasX:gRNA RNP complex and, optionally, a donor template. Combinations of structural proteins from different viruses can be used to create XDPs, including components from virus families including Parvoviridae (e.g., adeno-associated virus), Retroviridae (e.g., alpharetrovirus, a betaretrovirus, a gammaretrovirus, a deltaretrovirus, a epsilonretrovirus, or a lentivirus), Flaviviridae (e.g., Hepatitis C virus), Paramyxoviridae (e.g., Nipah) and bacteriophages (e.g., Qβ, AP205). In some embodiments, the disclosure provides XDP systems designed using components of retrovirus, including lentiviruses (such as HIV) and alpharetrovirus, betaretrovirus, gammaretrovirus, deltaretrovirus, epsilonretrovirus, in which individual plasmids comprising polynucleotides encoding the various components are introduced into a packaging cell that, in turn, produce the XDP. In some embodiments, the disclosure provides XDP comprising one or more components of i) protease, ii) a protease cleavage site, iii) one or more components of a Gag polyprotein selected from a matrix protein (MA), a nucleocapsid protein (NC), a capsid protein (CA), a p1 peptide, a p6 peptide, a P2A peptide, a P2B peptide, a P10 peptide, a p12 peptide, a PP21/24 peptide, a P12/P3/P8 peptide, and a P20 peptide; v) CasX; vi) gRNA, and vi) targeting glycoproteins or antibody fragments wherein the resulting XDP particle encapsidates a CasX:gRNA RNP. The polynucleotides encoding the Gag, CasX and gRNA can further comprise paired components designed to assist the trafficking of the components out of the nucleus of the host cell and facilitate recruitment of the complexed CasX:gRNA into the budding XDP. Non-limiting examples of such components include hairpin RNA such as MS2 hairpin, PP7 hairpin, Qβ hairpin, and U1 hairpin II incorporated into the gRNA as binding partners that have binding affinity for the packaging recruiter MS2 coat protein, PP7 coat protein, Qβ coat protein, and U1A signal recognition particle, respectively, that are fused to the Gag polyprotein. It has been discovered that the incorporation of the binding partner inserted into the guide RNA and the packaging recruiter into the nucleic acid comprising the Gag polypeptide facilitates the packaging of the XDP particle due, in part, to the affinity of the CasX for the gRNA, resulting in an RNP, such that both the gRNA and CasX are associated with Gag during the encapsidation process of the XDP, increasing the proportion of XDP comprising RNP compared to a construct lacking the binding partner and packaging recruiter. In other embodiments, the gRNA can comprise Rev response element (RRE) or portions thereof that have binding affinity to Rev, which can be linked to the Gag polyprotein. In other embodiments, the gRNA can comprise one or more RRE and one or more MS2 hairpin sequences. The RRE can be selected from the group consisting of Stem IIB of Rev response element (RRE), Stem II-V of RRE, Stem II of RRE, Rev-binding element (RBE) of Stem IIB, and full-length RRE. In the foregoing embodiment, the components include sequences of UGGGCGCAGCGUCAAUGACGCUGACGGUACA (Stem IIB, SEQ ID NO: 1280), GCAC-UAUGGGCGCAGCGUCAAUGACGCUGACGGUA-CAGGCCAGACAAUUAUUGU CUGGUAUAGUGC (Stem II, SEQ ID NO: 1281), CAGGAAGCAC-UAUGGGCGCAGCGUCAAUGACGCUGACGGUA-CAGGCCAGACAAU UAUUGUCUG-GUAUAGUGCAGCAGCAGAACAAUUUGCUGAGGGC-UAUUGAGGCGC AACAGCAUCUGUUGCAACUCACAGUCUGGGG-CAUCAAGCAGCUCCAGGCAAGAA UCCUG (Stem II-V, SEQ ID NO: 1282), GCUGACGGUACAGGC (RBE, SEQ ID NO: 1284), and AGGAGCUUUGUUCCUUGG-GUUCUUGGGAGCAGCAGGAAGCAC-UAUGGGCGCAGC GUCAAUGACGCUGACGGUA-CAGGCCAGACAAUUAUUGUCUGGUAUAGUGCAGC-GCAGAACAAUUUGCUGAGGGC-UAUUGAGGCGCAACAGCAUCUGUUGCAACUCAC AGUCUGGGGCAUCAAGCAG-CUCCAGGCAAGAAUCCUGGCUGUG-GAAAGAUACCU AAAGGAUCAACAGCUCCU (full-length RRE, SEQ ID NO: 1283). In other embodiments, the gRNA can comprise one or more RRE and one or more MS2 hairpin sequences. In a particular embodiment, the gRNA comprises an MS2 hairpin variant that is optimized to increase the binding affinity to the MS2 coat protein, thereby enhancing the incorporation of the gRNA and associated CasX into the budding XDP. In some embodiments, gRNA variants comprising MS2 hairpin variants and RRE include gRNA variants 275-315 (SEQ ID NOS: 2353-2393), comprising MS2 sequences as set forth in Table 36. In some embodiments, the disclosure provides gRNA variants comprising one or more MS2 hairpin sequence variants, wherein the variant exhibits a $K_D$ to its MS2 coat protein ligand of less than 100 nM, less than 50 nM, less than 35 nM, less than 10 nM, less than 3 nM, or less than 2 nM and the XDP comprising the gRNA variant exhibits improved editing activity towards a target nucleic acid in an in vitro cellular assay, wherein the $EC_{50}$ is less than $10^8$, or less than $10^7$, or less than $10^6$ particles to achieve editing in 50% of the cells. The targeting glycoproteins or antibody fragments on the surface that provides tropism of the XDP to the target cell, wherein upon administration and entry into the target cell, the RNP molecule is free to be transported into the nucleus of the cell. The envelope glycoprotein can be derived from any enveloped viruses known in the art to confer tropism to XDP, including but not limited to the group consisting of Argentine hemorrhagic fever virus, Australian bat virus, *Autographa californica* multiple nucleopolyhedrovirus, Avian leukosis virus, baboon endogenous virus, Bolivian hemorrhagic fever virus, Borna disease virus, Breda virus, Bunyamwera virus, Chandipura virus, Chikungunya virus, Crimean-Congo hemorrhagic fever virus, Dengue fever virus, Duvenhage virus, Eastern equine encephalitis virus, Ebola hemorrhagic fever virus, Ebola Zaire virus, enteric adenovirus, Ephemerovirus, Epstein-Bar virus (EBV), European bat virus 1, European bat virus 2, Fug Synthetic gP Fusion, Gibbon ape leukemia virus, Hantavirus, Hendra virus, hepatitis A virus, hepatitis B virus, hepatitis C virus, hepatitis D virus, hepatitis E virus, hepatitis G Virus (GB virus C), herpes simplex virus type 1, herpes simplex virus type 2, human cytomegalovirus (HHV5), human foamy virus, human herpesvirus (HHV), human Herpesvirus 7, human herpesvirus type 6, human herpesvirus type 8, human immunodeficiency virus 1 (HIV-1), human metapneumovirus, human T-lymphotropic virus 1, influenza A, influenza B, influenza C virus, Japanese encephalitis virus, Kaposi's sarcoma-associated herpesvirus (HHV8), Kaysanur Forest disease virus, La Crosse virus, Lagos bat virus, Lassa fever virus, lymphocytic choriomeningitis virus (LCMV), Machupo virus, Marburg hemorrhagic fever virus, measles virus, Middle eastern respiratory syndrome-related coronavirus, Mokola virus, Moloney murine leukemia virus, monkey pox, mouse mammary tumor virus, mumps virus, murine gammaherpesvirus, Newcastle disease virus, Nipah virus, Nipah virus, Norwalk virus, Omsk hemorrhagic fever virus, papilloma virus, parvovirus, pseudorabies virus, Quaranfil virus, rabies virus, RD114 Endogenous Feline Retrovirus, respiratory syncytial virus (RSV), Rift Valley fever virus, Ross River virus, rRotavirus, Rous sarcoma virus, rubella virus, Sabia-associated hemorrhagic fever virus, SARS-associated coronavirus (SARS-CoV), Sendai virus, Tacaribe virus, Thogotovirus, tick-borne encephalitis causing virus, varicella zoster virus (HHV3), varicella zoster virus (HHV3), variola major virus, variola minor virus, Venezuelan equine encephalitis virus, Venezuelan hemorrhagic fever virus, vesicular stomatitis virus (VSV), VSV-G, Vesiculovirus, West Nile virus, western equine encephalitis virus, and Zika Virus.

In other embodiments, the disclosure provides XDP of the foregoing and further comprises one or more components of a pol polyprotein (e.g., a protease), and, optionally, a second CasX or a donor template. The disclosure contemplates multiple configurations of the arrangement of the encoded components, including duplicates of some of the encoded components. The foregoing offers advantages over other vectors in the art in that viral transduction to dividing and non-dividing cells is efficient and that the XDP delivers potent and short-lived RNP that escape a subject's immune surveillance mechanisms that would otherwise detect a foreign protein. Non-limiting, exemplary XDP systems are described in PCT/US20/63488 and WO2021113772A1, incorporated by reference herein. In some embodiments, the disclosure provides host cells comprising polynucleotides or vectors encoding any of the foregoing XDP embodiments.

Upon production and recovery of the XDP comprising the CasX:gRNA RNP of any of the embodiments described herein, the XDP can be used in methods to edit target cells of subjects by the administering of such XDP, as described more fully, below.

For non-viral delivery, vectors can also be delivered wherein the vector or vectors encoding the CasX variants and gRNA are formulated in nanoparticles, wherein the nanoparticles contemplated include, but are not limited to nanospheres, liposomes, lipid nanoparticles, quantum dots, polyethylene glycol particles, hydrogels, and micelles. Lipid nanoparticles are generally composed of an ionizable cationic lipid and three or more additional components, such as cholesterol, DOPE, polylactic acid-co-glycolic acid, and a polyethylene glycol (PEG) containing lipid. In some embodiments, the CasX variants of the embodiments disclosed herein are formulated in a lipid nanoparticle. In some embodiments, the lipid nanoparticle comprises the gRNA of the embodiments disclosed herein. In some embodiments, the lipid nanoparticle comprises RNP of the CasX variant complexed with the gRNA. In some embodiments, the system comprises a lipid nanoparticle comprising nucleic acids encoding the CasX variants and the gRNA and, optionally, a donor template nucleic acid. In some embodiments, the components of the CasX:gRNA system are formulated in separate lipid nanoparticles for delivery to cells or for administration to a subject in need thereof.

VII. Methods for Modification of a Target Nucleic Acid

The CRISPR proteins, guides, nucleic acids, and variants thereof provided herein, as well as vectors encoding such components, are useful for various applications, including therapeutics, diagnostics, and research.

In some embodiments, to effect the methods of the disclosure for gene editing and modification of a target nucleic acid in a cell, provided herein are programmable Class 2, Type V CasX variant and gRNA variant editing pairs (CasX:gRNA). The programmable nature of the pairs provided herein allows for the precise targeting to achieve the desired modification at one or more regions of predetermined interest in the gene target nucleic acid. A variety of strategies and methods can be employed to modify the target nucleic acid sequence in a cell using the systems provided herein. As used herein "modifying" includes, but is not limited to, cleaving, nicking, editing, deleting, knocking out, knocking down, mutating, correcting, exon-skipping and the like. As described herein, a CasX variant introducing double-stranded cleavage of the target nucleic acid generates a double-stranded break within 18-26 nucleotides 5' of a PAM site on the target strand and 10-18 nucleotides 3' on the non-target strand. The resulting modification can result in random insertions or deletions (indels), or a substitution, duplication, frame-shift, or inversion of one or more nucleotides in those regions by non-homologous DNA end joining (NHEJ) repair mechanisms.

In some embodiments, the disclosure provides methods of modifying a target nucleic acid in a cell, the method comprising contacting the target nucleic acid of the cell with: i) a Class 2, Type V CRISPR protein and gRNA (CasX:gRNA) editing pair comprising a CasX variant and a gRNA variant of any one of the embodiments described herein; ii) a CasX:gRNA editing pair together with a donor template of any one of the embodiments described herein; iii) a nucleic acid encoding the CasX and the gRNA editing pair, and optionally comprising the donor template; iv) a vector comprising the nucleic acid of (iii), above; v) an XDP comprising the CasX:gRNA editing pair of any one of the embodiments described herein; or vi) combinations of two or more of (i) to (v), wherein the contacting of the target nucleic acid with a CasX protein and gRNA gene editing pair and, optionally, the donor template, modifies the target nucleic acid. In some cases, the modification results in a correction or compensation of a mutation in a cell, thereby creating an edited cell such that expression of a functional gene product can occur. In other embodiments of the method, the modification comprises suppressing or eliminating expression of the gene product by a knock-down or knock-out of the gene.

In some embodiments of the method of modifying a target nucleic acid sequence in a cell, wherein the method comprises contacting the target nucleic acid of the cell with a CasX:gRNA editing pair, wherein the editing pair comprises a CasX variant selected from the group consisting of SEQ ID NOS: 247-592 and 1147-1231 as set forth in Table 3, a CasX variant selected from the group consisting of SEQ ID NOS: 270-592 and 1147-1231, a CasX variant selected from the group consisting of SEQ ID NOS: 415-592 and 1147-1231, or a variant sequence at least 60% identical, at least 70% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, or at least 99.5% identical thereto, the gRNA scaffold comprises a sequence selected from the group consisting of SEQ ID NOS: 2101-2332 and 2353-2398 as set forth in Table 2, the gRNA scaffold comprises a sequence selected from the group consisting of SEQ ID NOS: 2238-2332 and 2353-2398, the RNA scaffold comprises a sequence selected from the group consisting of SEQ ID NOS: 2281-2332 and 2353-2398, or a sequence at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical thereto, and the gRNA comprises a targeting sequence that is complementary to the target nucleic acid and is capable of hybridizing with the target nucleic acid.

In some embodiments, the CasX:gRNA gene editing pair are capable of associating together in a ribonuclear protein complex (RNP). In some embodiments, the CasX:gRNA gene editing pair are associated together in a ribonuclear protein complex (RNP). In some embodiments, the RNP is capable of binding and generating a double-stranded break in the target nucleic acid that results in a permanent indel or mutation in the target nucleic acid. In other embodiments, the RNP is capable of binding a target nucleic acid and generating one or more single-stranded nicks in the target nucleic acid that results in a permanent indel or mutation in the target nucleic acid. In other embodiments, the RNP is capable of binding a target nucleic acid but is not capable of cleaving the target nucleic acid; i.e., contains a dCasX variant. In some embodiments of the method, the CasX variant protein may be provided to cells as a polypeptide that may optionally be fused to a polypeptide domain that increases solubility of the product. The domain may be linked to the polypeptide through a defined protease cleavage site; e.g. a TEV sequence, which is cleaved by TEV protease. The linker may also include one or more flexible sequences; e.g. from 1 to 10 glycine residues. In some embodiments, the cleavage of the fusion protein is performed in a buffer that maintains solubility of the product; e.g. in the presence of from 0.5 to 2 M urea, in the presence of polypeptides and/or polynucleotides that increase solubility, and the like. Domains of interest may include endosomolytic domains; e.g. influenza HA domain; and other polypeptides that aid in production, e.g. IF2 domain, GST domain, GRPE domain, and the like. The polypeptide may be formulated for improved stability. For example, the peptides may be PEGylated, where the polyethyleneoxy group provides for enhanced lifetime in the blood stream.

In other embodiments of the method of modifying a target nucleic acid sequence in a cell, the method comprises contacting the target nucleic acid sequence with a plurality of RNPs with a first and a second, or a plurality of gRNAs targeted to different or overlapping portions of the gene wherein the CasX protein introduces multiple breaks in the target nucleic acid that result in permanent indels or mutations in the target nucleic acid, as described herein, or an excision of the intervening sequence between the breaks with a corresponding modulation of expression or alteration in the function of the gene product, thereby creating a modified cell.

In some embodiments, the method of modifying a target nucleic acid comprises contacting a target nucleic acid with a CasX:gRNA gene editing pair as described herein and a donor template. Thus, in some cases, a method as provided herein includes contacting the target nucleic acid with a donor polynucleotide (e.g., by introducing the donor polynucleotide into a cell), wherein the donor polynucleotide, a portion of the donor polynucleotide, a copy of the donor polynucleotide, or a portion of a copy of the donor polynucleotide is integrated into the target nucleic acid. For example, an exogenous donor template may comprise a corrective sequence to be integrated flanked by an upstream sequence and a downstream sequence that is introduced into the target nucleic acid sequence in a cell. In other cases, the donor template may contain one or more single base changes, insertions, deletions, inversions or rearrangements with respect to the genomic sequence, provided that there is sufficient homology with the target nucleic acid sequence to support its integration into the target nucleic acid, which can result in a frame-shift or other mutation, or a replacement of that portion of the target nucleic acid sequence, with a corresponding knock-down or knock-out of the defective gene in a cell. The upstream and downstream sequences relative to the cleavage site(s) share sequence similarity with either side of the site of integration in the target nucleic acid (i.e., homologous arms), facilitating the insertion. In other cases, an exogenous donor template is inserted between the ends generated by CasX cleavage by homology-independent targeted integration (HITI) mechanisms. The exogenous sequence inserted by HITI can be any length, for example, a relatively short sequence of between 10 and 50 nucleotides in length, or a longer sequence of about 50-1000 nucleotides in length. The lack of homology can be, for example, having no more than 20-50% sequence identity and/or lacking in specific hybridization at low stringency. In other cases, the lack of homology can further include a criterion of having no more than 5, 6, 7, 8, or 9 bp identity. In some embodiments, the donor template polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000 nucleotides. In other embodiments, the donor template comprises at least about 10 to about 15,000 nucleotides, or at least about 100 to about 10,000 nucleotides, or at least about 400 to about 8,000 nucleotides, or at least about 600 to about 5000 nucleotides, or at least about 1000 to about 2000 nucleotides. In some embodiments, the donor template is a single stranded DNA template or a single stranded RNA template. In other embodiments, the donor template is a double stranded DNA template. The donor template sequence may comprise certain sequence differences as compared to the genomic sequence, e.g., restriction sites, nucleotide polymorphisms, selectable markers (e.g., drug resistance genes, fluorescent proteins, enzymes etc.), etc., which may be used to assess for successful insertion of the donor nucleic acid at the cleavage site or in some cases may be used for other purposes (e.g., to signify expression at the targeted genomic locus). Alternatively, these sequence differences may include flanking recombination sequences such as FLPs, loxP sequences, or the like.

In some embodiments, the disclosure provides methods of modifying a target nucleic acid sequence of a cell, comprising contacting the target nucleic acid of said cell with one or more polynucleotides of any of the embodiments described herein, wherein the polynucleotide(s) encode a CasX:gRNA gene editing pair, wherein the gRNA comprises a targeting sequence complementary to, and therefore capable of hybridizing with, the target nucleic acid sequence, and wherein the contacting results in modification of the target nucleic acid. Methods of introducing a nucleic acid (e.g., a nucleic acid comprising a donor polynucleotide sequence, one or more nucleic acids encoding a CasX variant protein and a gRNA variant as described herein) into a cell are known in the art, and any convenient method can be used. Suitable methods include viral infection, transfection, lipofection, electroporation, calcium phosphate precipitation, polyethyleneimine (PEI)-mediated transfection, DEAE-dextran mediated transfection, liposome-mediated transfection, particle gun technology, nucleofection, electroporation, direct addition by cell-penetrating CasX proteins that are fused to or recruit donor DNA, cell squeezing, calcium phosphate precipitation, direct microinjection, and nanoparticle-mediated nucleic acid delivery. Nucleic acids may be provided to the cells using well-developed transfection techniques, and the commercially available TransMessenger® reagents from Qiagen, Stemfect™ RNA Transfection Kit from Stemgent, and TransIT®-mRNA Transfection Kit from Mirus Bio LLC, Lonza nucleofection, Maxagen electroporation and the like. A nucleic acid comprising a nucleotide sequence encoding a CasX variant protein is in some cases an RNA. Thus, in some embodiments a CasX variant protein can be introduced into cells as RNA. Methods of introducing RNA into cells are known in the art and may include, for example, direct injection, transfection, or any other method used for the introduction of DNA.

In other embodiments, the disclosure provides methods of modifying a target nucleic acid sequence of a cell, comprising contacting said cell with a vector of any of the embodiments described herein comprising a nucleic acid encoding a CasX:gRNA gene editing pair comprising a CasX variant protein and a gRNA variant of any of the embodiments described herein and, optionally, a donor template, wherein the gRNA comprises a targeting sequence complementary to, and therefore capable of hybridizing with, the target nucleic acid sequence, wherein the contacting results in modification of the target nucleic acid. Introducing recombinant expression vectors into cells can occur in any suitable culture media and under any suitable culture conditions that promote the survival of the cells. Introducing recombinant expression vectors into a target cell can be carried out in vivo, in vitro or ex vivo.

In some embodiments, vectors may be provided directly to a target host cell. For example, cells may be contacted with vectors comprising the subject nucleic acids (e.g., recombinant expression vectors having the donor template sequence and encoding the gRNA variant and the CasX variant protein) such that the vectors are taken up by the cells. Methods for contacting cells with nucleic acid vectors that are plasmids include electroporation, calcium chloride transfection, microinjection, and lipofection are well known in the art. For viral vector delivery, cells can be contacted with viral particles comprising the subject viral expression vectors; e.g., the vectors are viral particles such as AAV or VLP that comprise polynucleotides that encode the CasX: gRNA components. For non-viral delivery, vectors or the CasX:gRNA components can also be formulated for delivery in lipid nanoparticles, wherein the lipid nanoparticles contemplated include, but are not limited to nanospheres, liposomes, quantum dots, polyethylene glycol particles, hydrogels, and micelles.

In some embodiments, the editing of the target nucleic acid occurs in vitro, inside of a cell, for example in a cell culture system. In some embodiments, the editing occurs in vivo inside of a cell of a subject, for example in a cell in an animal. In some embodiments, the cell is a eukaryotic cell. Exemplary eukaryotic cells may include cells selected from the group consisting of a mouse cell, a rat cell, a pig cell, a dog cell, and a non-human primate cell. In some embodiments, the cell is a human cell. Non-limiting examples of cells include an embryonic stem cell, an induced pluripotent stem cell, a germ cell, a fibroblast, an oligodendrocyte, a glial cell, a hematopoietic stem cell, a neuron progenitor cell, a neuron, a muscle cell, a bone cell, a hepatocyte, a pancreatic cell, a retinal cell, a cancer cell, a T-cell, a B-cell, an NK cell, a fetal cardiomyocyte, a myofibroblast, a mesenchymal stem cell, an autotransplanted expanded cardiomyocyte, an adipocyte, a totipotent cell, a pluripotent cell, a blood stem cell, a myoblast, an adult stem cell, a bone marrow cell, a mesenchymal cell, a parenchymal cell, an epithelial cell, an endothelial cell, a mesothelial cell, fibroblasts, osteoblasts, chondrocytes, exogenous cell, endogenous cell, stem cell, hematopoietic stem cell, bone-marrow derived progenitor cell, myocardial cell, skeletal cell, fetal cell, undifferentiated cell, multi-potent progenitor cell, unipotent progenitor cell, a monocyte, a cardiac myoblast, a skeletal myoblast, a macrophage, a capillary endothelial cell, a xenogenic cell, an allogenic cell, or a post-natal stem cell. In alternative embodiments, the cell is a prokaryotic cell.

In some embodiments of the methods of modifying a target nucleic acid of a cell in vitro or ex vivo, to induce cleavage or any desired modification to a target nucleic acid, the gRNA variant and the CasX variant protein of the present disclosure and, optionally, the donor template sequence, whether they be introduced as nucleic acids or polypeptides, complexed RNP, vectors or XDP, are provided to the cells for about 30 minutes to about 24 hours, or at least about 1 hour, 1.5 hours, 2 hours, 2.5 hours, 3 hours, 3.5 hours 4 hours, 5 hours, 6 hours, 7 hours, 8 hours, 12 hours, 16 hours, 18 hours, 20 hours, or any other period from about 30 minutes to about 24 hours, which may be repeated with a frequency of about every day to about every 4 days, e.g., every 1.5 days, every 2 days, every 3 days, or any other frequency from about every day to about every four days. The agent(s) may be provided to the subject cells one or more times, e.g., one time, twice, three times, or more than three times, and the cells allowed to incubate with the agent(s) for some amount of time following each contacting event; e.g., 30 minutes to about 24 hours. In the case of in vitro-based methods, after the incubation period with the CasX and gRNA (and optionally the donor template), the media is replaced with fresh media and the cells are cultured further.

In some embodiments, the method comprises administering to a subject a therapeutically-effective dose of a population of cells modified to correct or compensate for the mutation of the gene. In some embodiments, the administration of the modified cells results in the expression of wild-type or a functional gene product in the subject. In some embodiments of the method, the dose of total cells is within a range of between at or about $10^4$ and at or about $10^9$ cells/kilograms (kg) body weight, such as between $10^5$ and $10^6$ cells/kg body weight, for example, at or about $1\times10^5$ cells/kg, $1.5\times10^5$ cells/kg, $2\times10^5$ cells/kg, or $1\times10^6$ cells/kg body weight. For example, in some embodiments, the cells are administered at, or within a certain range of error of, between at or about $10^4$ and at or about $10^9$ cells/kilograms (kg) body weight, such as between $10^5$ and $10^6$ cells/kg body weight, for example, at or about $1\times10^5$ cells/kg, $1.5\times10^5$ cells/kg, $2\times10^5$ cells/kg, or $1\times10^6$ cells/kg body weight. In one embodiment, the cells are autologous with respect to the subject to be administered the cells. In another embodiment, the cells are allogeneic with respect to the subject to be administered the cells. In some cases, the subject is selected from the group consisting of mouse, rat, pig, and non-human primate. In other cases, the subject is a human.

VIII. Therapeutic Methods

In another aspect, the present disclosure relates to methods of treating a disease or disorder in a subject in need thereof. A number of therapeutic strategies have been used to design the systems for use in the methods of treatment of a subject with a disease or disorder related to a genetic mutation. In some embodiments, the modification of the target nucleic acid occurs in a subject having a mutation in an allele of a gene wherein the mutation causes a disease or disorder in the subject. In some embodiments, the modification of the target nucleic acid changes the mutation to a wild type allele of the gene or results in the expression of a functional gene product. In some embodiments, the modification of the target nucleic acid knocks down or knocks out expression of an allele of a gene causing a disease or disorder in the subject.

In some embodiments, the method comprises administering to the subject a therapeutically effective dose of a system comprising a gene editing pair of a Class 2, Type V CRISPR nuclease variant and guide RNA variant disclosed herein. In some embodiments, the method of treatment comprises administering to the subject a therapeutically effective dose of: i) a CasX:gRNA system comprising a first CasX variant and a first gRNA variant (with a targeting sequence complementary to the target nucleic acid to be modified) of any of the embodiments described herein; ii) a CasX:gRNA system comprising a first CasX protein and a first gRNA with a targeting sequence complementary to the target nucleic acid and a donor template; iii) a nucleic acid encoding the CasX:gRNA system of (i) or (ii); iv) a vector comprising the nucleic acid of (iii), which can be an AAV of any of the embodiments described herein; v) a XDP comprising the CasX:gRNA system of (i) or (ii); or vi) combinations of two or more of (i)-(v), wherein 1) the gene of the cells of the subject targeted by the first gRNA is modified (e.g., knocked-down or knocked-out) by the CasX protein (and, optionally, the donor template); or 2) the gene of the cells of the subject targeted by the first gRNA is corrected or modified by the CasX protein (and, optionally, the donor template) such that a functional gene product can be expressed. In some embodiments, the method of treating further comprises administering a second or a plurality of gRNA or a nucleic acid encoding the second or plurality of gRNA, wherein the second or plurality of gRNA have targeting sequences complementary to a different or overlapping portion of the target nucleic acid sequence compared to the first gRNA. It will be understood that in the foregoing, each different gRNA is paired with a CasX protein. In embodiments in which two or more gene editing pairs are provided to the cell (e.g., comprising two gRNA comprising two or more different spacers that are complementary to different sequences within the same or different target nucleic acid), the gene pairs may be provided simultaneously (e.g., as two RNPS and/or vectors), or delivered simultaneously. Alternatively, they may be provided consecutively, e.g., the first gene editing pair being provided first, followed by the second gene editing pair, or vice versa.

In some embodiments, method of treatment comprises administering a therapeutically effective dose of an AAV vector encoding the CasX:gRNA system, and is administered to the subject at a dose of at least about $1\times10^5$ vector genomes/kg (vg/kg), at least about $1\times10^6$ vg/kg, at least about $1\times10^7$ vg/kg, at least about $1\times10^8$ vg/kg, at least about $1\times10^9$ vg/kg, at least about $1\times10^{10}$ vg/kg, at least about $1\times10^{11}$ vg/kg, at least about $1\times10^{12}$ vg/kg, at least about $1\times10^{13}$ vg/kg, at least about $1\times10^{14}$ vg/kg, at least about $1\times10^{15}$ vg/kg, or at least about $1\times10^{16}$ vg/kg. In other embodiments of the method, the AAV vector is administered to the subject at a dose of at least about $1\times10^5$ vg/kg to about $1\times10^{16}$ vg/kg, at least about $1\times10^6$ vg/kg to about $1\times10^{15}$ vg/kg, or at least about $1\times10^7$ vg/kg to about $1\times10^{14}$ vg/kg. In the foregoing, the AAV vector is selected from AAV1, AAV2, AAV3, AAV4, AAV5, AAV6, AAV7, AAV8, AAV9, AAV10, AAV-Rh74, or AAVRh10. In other embodiments, the method of treatment comprises administering a therapeutically effective dose of a XDP comprising RNP of the CasX:gRNA system to the subject. In one embodiment, the XDP is administered to the subject at a dose of at least about $1\times10^5$ particles/kg, at least about $1\times10^6$ particles/kg, at least about $1\times10^7$ particles/kg at least about $1\times10^8$ particles/kg, at least about $1\times10^9$ particles/kg, at least about $1\times10^{10}$ particles/kg, at least about $1\times10^{11}$ particles/kg, at least about $1\times10^{12}$ particles/kg, at least about $1\times10^{13}$ particles/kg, at least about $1\times10^{14}$ particles/kg, at least about $1\times10^{15}$ particles/kg, at least about $1\times10^{16}$ particles/kg. In another embodiment, the XDP is administered to the subject at a dose of at least about $1\times10^5$ particles/kg to about $1\times10^{16}$ particles/kg, or at least about $1\times10^6$ particles/kg to about $1\times10^{15}$ particles/kg, or at least about $1\times10^7$ particles/kg to about $1\times10^{14}$ particles/kg. The vector or XDP can be administered by a route of administration selected from the group consisting of intraparenchymal, intravenous, intra-arterial, intramuscular, subcutaneous, intracerebroventricular, intracisternal, intrathecal, intracranial, intravitreal, subretinal, intracapsular, and intraperitoneal routes or combinations thereof, wherein the administering method is injection, transfusion, or implantation. The administration can be once, twice, or can be administered multiple times using a regimen schedule of weekly, every two weeks, monthly, quarterly, every six months, once a year, or every 2 or 3 years. In some cases, the subject is selected from the group consisting of mouse, rat, pig, and non-human primate. In other cases, the subject is a human.

In some embodiments of the method, the modifying comprises introducing a single-stranded break in the target nucleic acid of the targeted cells of a subject. In other cases, the modifying comprises introducing a double-stranded break in the target nucleic acid of the targeted cells of a subject. In some embodiments, the modifying introduces one or more mutations in the target nucleic acid, such as an insertion, deletion, substitution, duplication, or inversion of one or more nucleotides in the gene, wherein expression of the gene product in the modified cells of the subject is reduced by at least about 10%, at least about 20%, at least about 30%, at least about 40%, at least about 50%, at least about 60%, at least about 70%, at least about 80%, or at least about 90% in comparison to a cell that has not been modified. In some cases, the gene of the modified cells of the subject are modified such that least 70%, at least 75%, at least 80%, at least 85%, at least 90%, or at least 95% of the modified cells do not express a detectable level of the gene product. In some embodiments, the administering of the therapeutically effective amount of a CasX:gRNA system to knock down or knock out expression of a gene product to a subject with a disease leads to the prevention or amelioration of the underlying disease such that an improvement is observed in the subject, notwithstanding that the subject may still be afflicted with the underlying disease. In other embodiments, the gene can be modified by the NHEJ host repair mechanisms, or utilized in conjunction with a donor template that is inserted by HDR or HITI mechanisms to either excise, correct, or compensate for the mutation in the cells of the subject, such that expression of a wild-type or functional gene product in modified cells is increased by at least about 50%, at least about 60%, at least about 70%, at least about 80%, at least about 90%, or at least about 95% in comparison to a cell that has not been modified. In some embodiments, the administration of the therapeutically effective amount of the CasX-gRNA system leads to an improvement in at least one clinically-relevant parameter for a disease.

In some cases, a nucleic acid of the present disclosure (e.g., a recombinant expression vector of the present disclosure) or the CasX variant or gRNA variant can be covered with lipids in an organized structure like a micelle, a liposome, or a lipid nanoparticle. When the organized structure is complexed with DNA it is called a lipoplex. There are three types of lipids, anionic (negatively-charged), neutral, or cationic (positively-charged). Lipoplexes that utilize cationic lipids have proven utility for gene transfer. Cationic lipids, due to their positive charge, naturally complex with the negatively charged DNA. Also as a result of their charge, they interact with the cell membrane. Endocytosis of the lipoplex then occurs, and the DNA is released into the cytoplasm. The cationic lipids also protect against degradation of the DNA by the cell.

In some cases, a nucleic acid of the disclosure (e.g., an expression vector) includes an insertion site for a guide sequence of interest. For example, a nucleic acid can include an insertion site for a guide sequence of interest, where the insertion site is immediately adjacent to a nucleotide sequence encoding the portion of a gRNA variant (e.g. the scaffold region) that does not change when the guide sequence is changed to hybridize to a desired target sequence. Thus, in some cases, an expression vector includes a nucleotide sequence encoding a gRNA, except that the portion encoding the spacer sequence portion of the gRNA is an insertion sequence (an insertion site). An insertion site is any nucleotide sequence used for the insertion of a spacer in the desired sequence. "Insertion sites" for use with various technologies are known to those of ordinary skill in the art and any convenient insertion site can be used. An insertion site can be for any method for manipulating nucleic acid sequences. For example, in some cases the insertion site is a multiple cloning site (MCS) (e.g., a site including one or more restriction enzyme recognition sequences), a site for ligation independent cloning, a site for recombination-based cloning (e.g., recombination based on ATT sites), a nucleotide sequence recognized by a CRISPR/Cas (e.g. Cas9) based technology, and the like.

IX. Cells

In still further embodiments, provided herein are cells comprising components of any of the CasX:gRNA systems described herein. In some embodiments, the cells comprise any of the gRNA variant embodiments as described herein, and further comprises a spacer that is complementary to the target nucleic acid. In some embodiments, the cells further comprise a CasX variant as described herein (e.g., the sequences of Tables 3 and 7). In other embodiments, the cells comprise RNP of any of the CasX:gRNA embodiments described herein. In other embodiments, the disclosure provides cells comprising vectors encoding the CasX:gRNA systems of any of the embodiments described herein. In still other embodiments, the cells comprise target nucleic acid that has been edited by the CasX:gRNA embodiments described herein; either to correct a mutation (knock-in) or to knock-down or knock-out a defective gene.

In some embodiments, the cell is a modified cell (e.g., a genetically-modified cell) comprising nucleic acid comprising a nucleotide sequence encoding a CasX variant protein of the disclosure. In some embodiments, the genetically modified cell is genetically modified with an mRNA comprising a nucleotide sequence encoding a CasX variant protein. In some embodiments, the cell is genetically modified with a recombinant expression vector comprising: a) a nucleotide sequence encoding a CasX variant protein of the present disclosure; and b) a nucleotide sequence encoding a gRNA of the disclosure, and, optionally, comprises a nucleotide sequence comprising a donor template. In some cases, such cells are used to produce the individual components or RNP of CasX:gRNA systems for use in editing target nucleic acid. In other cases, cells that have been genetically modified in this way may be administered to a subject for purposes such as gene therapy; e.g., to treat a disease or condition caused by a genetic mutation or defect.

A cell that can serve as a recipient for a CasX variant protein and/or gRNA of the present disclosure and/or a nucleic acid comprising a nucleotide sequence encoding a CasX variant protein and/or a gRNA variant, can be any of a variety of cells, including, e.g., in vitro cells; in vivo cells; ex vivo cells; primary cells; cells of an immortalized cell line; cancer cells; animal cells; plant cells; algal cells; fungal cells; etc. A cell can be a recipient of a CasX RNP of the present disclosure. A cell can be a recipient of a single component of a CasX system of the present disclosure. A cell can be a recipient of a vector encoding the CasX, gRNA and, optionally, a donor template of the CasX:gRNA systems of any of the embodiments described herein.

Non-limiting examples of cells that can serve as host cells for production of the CasX:gRNA systems disclosed herein include prokaryotic cells (e.g., E coli) and eukaryotic cells (e.g., Baby Hamster Kidney fibroblast (BHK) cells, human embryonic kidney 293 (HEK293) cells, human embryonic kidney 293T (HEK293T) cells, NS0 cells, SP2/0 cells, YO myeloma cells, P3X63 mouse myeloma cells, PER cells, PER.C6 cells, hybridoma cells, NIH3T3 cells, CV-1 (simian) in Origin with SV40 genetic material (COS) cells, HeLa cells, Chinese hamster ovary (CHO) cells, or yeast cells, or other eukaryotic cells known in the art suitable for the production of recombinant products In some embodiments, the disclosure provides populations of cells modified for administration to a subject for the treatment of a disease or disorder. Such cells can be autologous with respect to a subject to be administered said cell(s). In other embodiments, the cells can be allogeneic with respect to a subject to be administered said cell(s). A cell can be an animal cell or derived from an animal cell. A cell can be a mammalian cell or derived from a mammalian cell. A cell can be a rodent cell or derived from a rodent cell such as a rat or a mouse. A cell can be a non-human primate cell or derived from a non-human primate cell. A cell can be a human cell or derived from a human cell. Suitable cells may include, in some embodiments, a stem cell (e.g. an embryonic stem (ES) cell, an induced pluripotent stem (iPS) cell; a germ cell (e.g., an oocyte, a sperm, an oogonia, a spermatogonia, etc.); a somatic cell, e.g. a fibroblast, an oligodendrocyte, a glial cell, a hematopoietic stem cell, a neuron progenitor cell, a neuron, a muscle cell, a bone cell, a hepatocyte, a pancreatic cell, a retinal cell, a cancer cell, a T-cell, a B-cell, a fetal cardiomyocyte, a myofibroblast, a mesenchymal stem cell, an autotransplanted expanded cardiomyocyte, an adipocyte, a totipotent cell, a pluripotent cell, a blood stem cell, a myoblast, an adult stem cell, a bone marrow cell, a mesenchymal cell, a parenchymal cell, an epithelial cell, an endothelial cell, a mesothelial cell, fibroblasts, osteoblasts, chondrocytes, exogenous cell, endogenous cell, stem cell, hematopoietic stem cell, bone-marrow derived progenitor cell, myocardial cell, skeletal cell, fetal cell, undifferentiated cell, multi-potent progenitor cell, unipotent progenitor cell, a monocyte, a cardiac myoblast, a skeletal myoblast, a macrophage, a capillary endothelial cell, a xenogenic cell, an allogenic cell, and a post-natal stem cell. In some embodiments, the cell is an immune cell. In some cases, the immune cell is a T cell, a B cell, a monocyte, a natural killer cell, a dendritic cell, or a macrophage. In some cases, the immune cell is a cytotoxic T cell. In some cases, the immune cell is a helper T cell. In some cases, the immune cell is a regulatory T cell (Treg). In some cases, the cell expresses a chimeric antigen receptor (Car-T). In some embodiments, the cell is a stem cell. Stem cells may include, for example, adult stem cells. Adult stem cells can also be referred to as somatic stem cells. In some embodiments, the stem cell is a hematopoietic stem cell (HSC), neural stem cell or a mesenchymal stem cell. In other embodiments, the stem cell is a mesenchymal stem cell (MSC). MSCs originally derived from the embryonal mesoderm and isolated from adult bone marrow, can differentiate to form muscle, bone, cartilage, fat, marrow stroma, and tendon. Methods of isolating MSC are known in the art; and any known method can be used to obtain MSC.

X. Kits and Articles of Manufacture

In another aspect, provided herein are kits comprising a CasX protein and one or a plurality of gRNA of any of the embodiments of the disclosure and a suitable container (for example a tube, vial or plate). In some embodiments, the kit comprises a gRNA variant of the disclosure, or the reference gRNA of SEQ ID NO: 5 or SEQ ID NO: 4. Exemplary gRNA variants that can be included comprise a sequence of any one of SEQ ID NOS: 2238-XX, as set forth in Table 2.

In some embodiments, the kit comprises a CasX variant protein of the disclosure (e.g., a sequence of Table 3 and 7), or the reference CasX protein of SEQ ID NO: 1, SEQ ID NO: 2, or SEQ ID NO: 3. In exemplary embodiments, a kit of the disclosure comprises a CasX variant of any one of SEQ ID NOS: 247-592 and 1147-1231. In further exemplary embodiments, a kit of the disclosure comprises a CasX variant of any one of SEQ ID NOS: 270-592 and 1147-1231. In further exemplary embodiments, a kit of the disclosure comprises a CasX variant of any one of SEQ ID NOS: 415-592 and 1147-1231.

In some embodiments, the kit comprises a gRNA or a vector encoding a gRNA, wherein the gRNA comprises a sequence selected from the group consisting of SEQ ID NOS: 2101-2332 and 2353-2398. In some embodiments, the gRNA comprises a sequence selected from the group consisting of SEQ ID NOS: 2238-2332 and 2353-2398. In some embodiments, the gRNA comprises a sequence selected from the group consisting of SEQ ID NOS: 2281-2332 and 2353-2398. In some embodiments, the gRNA comprises a sequence selected from the group consisting of SEQ ID NOS: 2236, 2237, 2238, 2241, 2244, 2248, 2249, and 2259-2280. In some embodiments, the gRNA comprises a sequence selected from the group consisting of any one of the sequences set forth in Table 2.

In certain embodiments, provided herein are kits comprising a CasX protein and gRNA editing pair comprising a CasX variant protein of Table 3 and 7 and a gRNA variant as described herein (e.g., a sequence of Table 2). In exemplary embodiments, a kit of the disclosure comprises a CasX and gRNA editing pair, wherein the CasX variant comprises of any one of SEQ ID NOS: 247-592 or 1147-1231. In further exemplary embodiments, a kit of the disclosure comprises a CasX and gRNA editing pair, wherein the CasX variant comprises of any one of SEQ ID NOS: 270-592 and 1147-1231. In further exemplary embodiments, a kit of the disclosure comprises a CasX and gRNA editing pair, wherein the CasX variant comprises of any one of SEQ ID NOS: 415-592 and 1147-1231. In some embodiments, the gRNA of the gene editing pair comprises any one of SEQ ID NOS: 2101-2332 or 2353-2398. In some embodiments, the gRNA of the gene editing pair comprises any one of SEQ ID NOS: 2238-2332 or 2353-2398. In some embodiments, the gRNA of the gene editing pair comprises any one of SEQ ID NOS: 2281-2332 or 2353-2398 In some embodiments, the gRNA of the gene editing pair comprises any one of SEQ ID NOS: 2236, 2237, 2238, 2241, 2244, 2248, 2249, or 2259-2280.

In some embodiments, the kit further comprises a buffer, a nuclease inhibitor, a protease inhibitor, a liposome, a therapeutic agent, a label, a label visualization reagent, or any combination of the foregoing. In some embodiments, the kit further comprises a pharmaceutically acceptable carrier, diluent or excipient.

In some embodiments, the kit comprises appropriate control compositions for gene editing applications, and instructions for use.

In some embodiments, the kit comprises a vector comprising a sequence encoding a CasX variant protein of the disclosure, a gRNA variant of the disclosure, optionally a donor template, or a combination thereof.

The present description sets forth numerous exemplary configurations, methods, parameters, and the like. It should be recognized, however, that such description is not intended as a limitation on the scope of the present disclosure, but is instead provided as a description of exemplary embodiments. Embodiments of the present subject matter described above may be beneficial alone or in combination, with one or more other aspects or embodiments. Without limiting the foregoing description, certain non-limiting embodiments of the disclosure are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiments explicitly provided below:

ENUMERATED EMBODIMENTS

The invention may be defined by reference to the following enumerated, illustrative embodiments.

Set I

Embodiment 1. A variant of a reference CasX protein (CasX variant), wherein:
  a. the CasX variant comprises at least one modification in the reference CasX protein; and
  b. the CasX variant exhibits at least one improved characteristic as compared to the reference CasX protein, optionally wherein the variant comprises a sequence selected from those provided in Table 3 and 8.

Embodiment 2. The CasX variant of embodiment 1, wherein the improved characteristic of the CasX variant is selected from the group consisting of: improved folding of the CasX variant; improved binding affinity to a guide nucleic acid (gNA); improved binding affinity to a target DNA; improved ability to utilize a greater spectrum of one or more PAM sequences, including ATC, CTC, GTC, or TTC, in the editing of target DNA; improved unwinding of the target DNA; increased editing activity; improved editing efficiency; improved editing specificity; increased nuclease activity; increased target strand loading for double strand cleavage; decreased target strand loading for single strand nicking; decreased off-target cleavage; improved binding of non-target DNA strand; improved protein stability; improved protein solubility; improved protein:gRNA complex (RNP) stability; improved protein:gRNA complex solubility; improved protein yield; improved protein expression; improved fusion characteristics or a combination thereof.

Embodiment 3. The Cas X variant of embodiment 1 or 2, wherein the at least one modification comprises:
  a. at least one amino acid substitution in a domain of the CasX variant;
  b. at least one amino acid deletion in a domain of the CasX variant;
  c. at least one amino acid insertion in a domain of the CasX variant;

d. a substitution of all or a portion of a domain from a different CasX;

e. a deletion of all or a portion of a domain of the CasX variant; or f. any combination of (a)-(e).

Embodiment 4. The CasX variant of any one of embodiments 1-3, wherein the reference CasX protein comprises the sequence of SEQ ID NO: 1, SEQ ID NO: 2, SEQ ID NO: 3, SEQ ID NO: 270, or SEQ ID NO: 336.

Embodiment 5. The CasX variant of any one of embodiments 1-4, wherein the at least one modification is in a domain selected from:

a. a non-target strand binding (NTSB) domain;

b. a target strand loading (TSL) domain;

c. a helical I domain;

d. a helical II domain;

e. an oligonucleotide binding domain (OBD); or f. a RuvC DNA cleavage domain.

Embodiment 6. The CasX variant of embodiment 5, comprising at least one modification in the NTSB domain.

Embodiment 7. The CasX variant of embodiment 5, comprising at least one modification in the TSL domain.

Embodiment 8. The CasX variant of embodiment 5, comprising at least one modification in the helical I domain.

Embodiment 9. The CasX variant of any one of embodiments 5-8, comprising at least one modification in the helical II domain.

Embodiment 10. The CasX variant of embodiment 5, comprising at least one modification in the OBD domain.

Embodiment 11. The CasX variant of embodiment 5, comprising at least one modification in the RuvC DNA cleavage domain.

Embodiment 12. The CasX variant of any one of embodiments 5-11, wherein the modification results in an increased ability to edit the target DNA.

Embodiment 13. The CasX variant of any one of the embodiments 1 to 12, wherein the CasX variant is capable of forming a ribonuclear protein complex (RNP) with a guide nucleic acid (gNA).

Embodiment 14. The CasX variant of any one of embodiments 1 to 13, wherein the at least one modification comprises:

a. a substitution of 1 to 100 consecutive or non-consecutive amino acids in the CasX variant;

b. a deletion of 1 to 100 consecutive or non-consecutive amino acids in the CasX variant;

c. an insertion of 1 to 100 consecutive or non-consecutive amino acids in the CasX; or d. any combination of (a)-(c).

Embodiment 15. The CasX variant of embodiment 14, wherein the at least one modification comprises:

a. a substitution of 5-10 consecutive or non-consecutive amino acids in the CasX variant;

b. a deletion of 1-5 consecutive or non-consecutive amino acids in the CasX variant;

c. an insertion of 1-5 consecutive or non-consecutive amino acids in the CasX; or d. any combination of (a)-(c).

Embodiment 16. The CasX variant of any one of embodiments 1 to 15, wherein the CasX variant comprises two or more modifications in one domain.

Embodiment 17. The CasX variant of any one embodiments 1 to 16, wherein the CasX variant comprises modifications in two or more domains.

Embodiment 18. The CasX variant of any one of embodiments 1-15, comprising at least one modification of a region of non-contiguous amino acid residues of the CasX variant that form a channel in which gNA:target DNA complexing with the CasX variant occurs.

Embodiment 19. The CasX variant of any one of embodiments 1-15, comprising at least one modification of a region of non-contiguous amino acid residues of the CasX variant that form an interface which binds with the gNA.

Embodiment 20. The CasX variant of any one of embodiments 1-15, comprising at least one modification of a region of non-contiguous amino acid residues of the CasX variant that form a channel which binds with the non-target strand DNA.

Embodiment 21. The CasX variant of any one of embodiments 1-15, comprising at least one modification of a region of non-contiguous amino acid residues of the CasX variant that form an interface which binds with the protospacer adjacent motif (PAM) of the target DNA.

Embodiment 22. The CasX variant of any one of embodiments 1-15, comprising at least one modification of a region of non-contiguous surface-exposed amino acid residues of the CasX variant.

Embodiment 23. The CasX variant of any one of embodiments 1-15, comprising at least one modification of a region of non-contiguous amino acid residues that form a core through hydrophobic packing in a domain of the CasX variant.

Embodiment 24. The CasX variant of any one of embodiments 18-23, wherein the modification is one or more of a deletion, an insertion, or a substitution of one or more amino acids of the region.

Embodiment 25. The CasX variant of any one of embodiments 18-23, wherein between 2 to 15 amino acid residues of the region of the CasX variant are substituted with charged amino acids.

Embodiment 26. The CasX variant of any one of embodiments 18-23, wherein between 2 to 15 amino acid residues of a region of the CasX variant are substituted with polar amino acids.

Embodiment 27. The CasX variant of any one of embodiments 18-23, wherein between 2 to 15 amino acid residues of a region of the CasX variant are substituted with amino acids that stack with DNA or RNA bases.

Embodiment 28. The CasX variant of any one of embodiments 1-5, wherein the CasX variant has a sequence selected from the group consisting of the sequences of Table 3, or a sequence having at least about 50%, at least about 60%, at least about 70%, at least about 80%, at least about 90%, or at least about 95%, or at least about 96%, or at least about 97%, or at least about 98%, or at least about 99%, sequence identity thereto.

Embodiment 29. The CasX variant of any one of embodiments 1-5, further comprising a substitution of an NTSB and/or a helical 1b domain from a different CasX.

Embodiment 30. The CasX variant of embodiment 29, wherein the substituted NTSB and/or the helical 1b domain is from the reference CasX of SEQ ID NO: 1.

Embodiment 31. The CasX variant of any one of embodiments 1 to 30, further comprising one or more nuclear localization signals (NLS).

Embodiment 32. The CasX variant of embodiment 31, wherein the one or more NLS are selected from the group of sequences consisting of PKKKRKV (SEQ ID NO: 352), KRPAATKKAGQAKKKK (SEQ ID NO: 353), PAAKRVKLD (SEQ ID NO: 354), RQRRNELKRSP (SEQ ID NO: 355), NQSSNFGPMKGGNFG-GRSSGPYGGGGQYFAKPRNQGGY (SEQ ID NO: 356), RMRIZFKNKGKDTAELRRRRVEVSVELRKAKKD-EQILKRRNV (SEQ ID NO: 357), VSRKRPRP (SEQ ID NO: 358), PPKKARED (SEQ ID NO: 350, PQPKKKPL (SEQ ID NO: 360), SALIKKKKKMAP (SEQ ID NO: 361), DRLRR (SEQ ID NO: 362), PKQKKRK (SEQ ID NO: 363), RKLKKKIKKL (SEQ ID NO: 364), REKKKFLKRR (SEQ ID NO: 365), KRKGDEVDGVDEVAKKKSKK (SEQ ID NO: 366), RKCLQAGMNLEARKTKK (SEQ ID NO: 367), PRPRKIPR (SEQ ID NO: 368), PPRKKRTVV (SEQ ID NO: 369), NLSKKKKRKREK (SEQ ID NO: 370), RRPSRPFRKP (SEQ ID NO: 371), KRPRSPSS (SEQ ID NO: 372), KRGINDRNFWRGENERKTR (SEQ ID NO: 373), PRPPKMARYDN (SEQ ID NO: 374), KRSFSKAF (SEQ ID NO: 375), KLKIKRPVK (SEQ ID NO: 376), PKKKRKVPPPPAAKRVKLD (SEQ ID NO: 377), PKTRRRPRRSQRKRPPT (SEQ ID NO: 378), SRRR-KANPTKLSENAKKLAKEVEN (SEQ ID NO: 379), KTRRRPRRSQRKRPPT (SEQ ID NO: 380), RRKKRR-PRRKKRR (SEQ ID NO: 381), PKKKSRKPKKKSRK (SEQ ID NO: 382), HKKKHPDASVNFSEFSK (SEQ ID NO: 383), QRPGPYDRPQRPGPYDRP (SEQ ID NO: 384), LSPSLSPLLSPSLSPL (SEQ ID NO: 385), RGKGGKGLGKGGAKRHRK (SEQ ID NO: 386), PKR-GRGRPKRGRGR (SEQ ID NO: 387), and PKKKRKVPPPPKKKRKV (SEQ ID NO: 389).

Embodiment 33. The CasX variant of embodiment 31 or embodiment 32, wherein the one or more NLS are positioned at or near the C-terminus of the CasX protein.

Embodiment 34. The CasX variant of embodiment 31 or embodiment 32, wherein the one or more NLS are positioned at or near at the N-terminus of the CasX protein.

Embodiment 35. The CasX variant of embodiment 31 or embodiment 32, comprising at least two NLS, wherein the at least two NLS are positioned at or near the N-terminus and at or near the C-terminus of the CasX protein.

Embodiment 36. The CasX variant of any one of embodiments 2-35, wherein one or more of the improved characteristics of the CasX variant is at least about 1.1 to about 100-fold or more improved relative to the reference CasX protein of SEQ ID NO: 1, SEQ ID NO: 2, or SEQ ID NO: 3.

Embodiment 37. The CasX variant of embodiment 2-35, wherein one or more of the improved characteristics of the CasX variant is at least about 1.1, at least about 2, at least about 10, at least about 100-fold or more improved relative to the reference CasX protein of SEQ ID NO: 1, SEQ ID NO: 2, SEQ ID NO: 3, SEQ ID NO: 270, or SEQ ID NO: 336.

Embodiment 38. The CasX variant of any one of embodiments 2-37, wherein the improved characteristic comprises editing efficiency, and the CasX variant comprises a 1.1 to 100-fold improvement in editing efficiency compared to the reference CasX protein of SEQ ID NO: 270 or SEQ ID NO: 336.

Embodiment 39. The CasX variant of any one of embodiments 1 to 38, wherein the RNP comprising the CasX variant exhibits greater editing efficiency and/or binding of a target sequence in the target DNA when any one of the PAM sequences TTC, ATC, GTC, or CTC is located 1 nucleotide 5' to the non-target strand of the protospacer having identity with the targeting sequence of the gRNA in a cellular assay system compared to the editing efficiency and/or binding of an RNP comprising a reference CasX protein in a comparable assay system.

Embodiment 40. The CasX variant of embodiment 39, wherein the PAM sequence is TTC.

Embodiment 41. The CasX variant of embodiment 39, wherein the PAM sequence is ATC.

Embodiment 42. The CasX variant of embodiment 39, wherein the PAM sequence is CTC.

Embodiment 43. The CasX variant of embodiment 39, wherein the PAM sequence is GTC.

Embodiment 44. The CasX variant of any one of embodiments 39, wherein the improved editing efficiency and/or binding to the target DNA of the RNP comprising the CasX variant is at least about 1.1 to about 100-fold improved relative to the RNP comprising the reference CasX.

Embodiment 45. The CasX variant of any one of embodiments 1 to 44, wherein the CasX variant comprises between 400 and 2000 amino acids.

Embodiment 46. The CasX variant of any one of embodiments 1 to 45, wherein the CasX variant protein comprises a nuclease domain having nickase activity.

Embodiment 47. The CasX variant of any one of embodiments 1-45, wherein the CasX variant protein comprises a nuclease domain having double-stranded cleavage activity.

Embodiment 48. The CasX variant of any one of embodiments 1-45, wherein the CasX protein is a catalytically inactive CasX (dCasX) protein, and wherein the dCasX and the gNA retain the ability to bind to the target DNA.

Embodiment 49. The CasX variant of embodiment 48, wherein the dCasX comprises a mutation at residues:
 a. D672, and/or E769, and/or D935 corresponding to the CasX protein of SEQ ID NO:1; or
 b. D659, and/or E756, and/or D922 corresponding to the CasX protein of SEQ ID NO: 2.

Embodiment 50. The CasX variant of embodiment 49, wherein the mutation is a substitution of alanine for the residue.

Embodiment 51. The CasX variant of any one of embodiments 1 to 50, wherein the CasX variant comprises a first domain from a first CasX protein and second domain from a second CasX protein different from the first CasX protein.

Embodiment 52. The CasX variant of embodiment 51, wherein the first domain is selected from the group consisting of the NTSB, TSL, helical I, helical II, OBD, and RuvC domains.

Embodiment 53. The CasX variant of embodiment 51, wherein the second domain is selected from the group consisting of the NTSB, TSL, helical I, helical II, OBD, and RuvC domains.

Embodiment 54. The CasX variant of any one of embodiments 51 to 53, wherein the first and second domains are not the same domain.

Embodiment 55. The CasX variant of any one of embodiments 1 to 50, wherein the CasX variant comprises at least one chimeric domain comprising a first part from a first CasX protein and a second part from a second CasX protein different from the first CasX protein.

Embodiment 56. The CasX variant of embodiment 55, wherein the at least one chimeric domain is selected from the group consisting of the NTSB, TSL, helical I, helical II, OBD, and RuvC domains.

Embodiment 57. The CasX variant of embodiment 56, wherein the at least one chimeric domain comprises a chimeric RuvC domain.

Embodiment 58. The CasX variant of any one embodiments of 1 to 57, comprising a heterologous protein or domain thereof fused to the CasX.

Embodiment 59. The CasX variant of embodiment 58, wherein the heterologous protein or domain thereof is a base editor.

Embodiment 60. The CasX variant of embodiment 59, wherein the base editor is an adenosine deaminase, a cytosine deaminase or a guanine oxidase.

Embodiment 61. A variant of a reference guide nucleic acid scaffold (gNA variant) capable of binding a reference CasX protein or a CasX variant, wherein:
- a. the gNA variant comprises at least one modification compared to the reference guide nucleic acid scaffold sequence; and
- b. the gNA variant exhibits one or more improved characteristics compared to the reference guide nucleic acid scaffold.

Embodiment 62. The gNA variant of embodiment 61, wherein the one or more improved characteristics is selected from the group consisting of: improved stability; improved solubility; improved transcription of the gNA; improved resistance to nuclease activity; increased folding rate of the gNA; decreased side product formation during folding; increased productive folding; improved binding affinity to a CasX protein; improved binding affinity to a target DNA when complexed with the CasX protein; improved gene editing when complexed with the CasX protein; improved specificity of editing when complexed with the CasX protein; and improved ability to utilize a greater spectrum of one or more PAM sequences, including ATC, CTC, GTC, or TTC, in the editing of target DNA when complexed with the CasX protein.

Embodiment 63. The gNA variant of embodiment 61 or 62, wherein the reference guide scaffold comprises a sequence selected from the group consisting of the sequences of SEQ ID NOS: 4-16 or SEQ ID NO: 2238 or SEQ ID NO: 2239.

Embodiment 64. The gNA variant of any one of embodiments 61 to 63, wherein the at least one modification comprises:
- a. at least one nucleotide substitution in a region of the gNA variant;
- b. at least one nucleotide deletion in a region of the gNA variant;
- c. at least one nucleotide insertion in a region of the gNA variant;
- d. a substitution of all or a portion of a region of the gNA variant;
- e. a deletion of all or a portion of a region of the gNA variant; or
- f. any combination of (a)-(e).

Embodiment 65. The gNA variant of embodiment 64, wherein the region of the gNA variant is selected from the group consisting of extended stem loop, scaffold stem loop, triplex, and pseudoknot.

Embodiment 66. The gNA variant of embodiment 65, wherein the scaffold stem further comprises a bubble.

Embodiment 67. The gNA variant of embodiment 65 or embodiment 66, wherein the scaffold further comprises a triplex loop region.

Embodiment 68. The gNA variant of any one of embodiments 65-67, wherein the scaffold further comprises a 5' unstructured region.

Embodiment 69. The gNA variant of any one of embodiments 64 to 68, wherein the at least one modification comprises:
- a. a substitution of 1 to 15 consecutive or non-consecutive nucleotides in the gNA variant in one or more regions;
- b. a deletion of 1 to 10 consecutive or non-consecutive nucleotides in the gNA variant in one or more regions;
- c. an insertion of 1 to 10 consecutive or non-consecutive nucleotides in the gNA variant in one or more regions;
- d. a substitution of the scaffold stem loop or the extended stem loop with an RNA stem loop sequence from a heterologous RNA source with proximal 5' and 3' ends; or
- e. any combination of (a)-(d).

Embodiment 70. The gNA variant of any one of embodiments 61-69, comprising an extended stem loop region comprising at least 10, at least 100, at least 500, at least 1000, or at least 10,000 nucleotides.

Embodiment 71. The gNA variant of embodiment 69, wherein the heterologous RNA stem loop sequence increases the stability of the gNA.

Embodiment 72. The gNA variant of embodiment 71, wherein the heterologous RNA stem loop is capable of binding a protein, an RNA structure, a DNA sequence, or a small molecule.

Embodiment 73. The gNA variant of embodiment 71 or embodiment 72, wherein the heterologous RNA stem loop sequence is selected from MS2, Qβ, U1 hairpin II, Uvsx, or PP7 stem loops.

Embodiment 74. The gNA variant of any one of embodiments 61-73, the gNA variant comprises two or more modifications in one region.

Embodiment 75. The gNA variant of any one of embodiments 61-74, wherein the gNA variant comprises modifications in two or more regions.

Embodiment 76. The gNA variant of any one of embodiments 61-75, wherein the gNA variant further comprises a targeting sequence wherein the targeting sequence is complementary to the target DNA sequence.

Embodiment 77. The gNA variant of embodiment 76, wherein the targeting sequence has 14, 15, 16, 17, 18, 19, 20, 21, 22, 23, 24, 25, 26, 27, 28, 29, 30, 31, 32, 33, 34 or 35 nucleotides.

Embodiment 78. The gNA variant of any one of embodiments 76 or embodiment 77, wherein the targeting sequence has 20 nucleotides.

Embodiment 79. The gNA variant of any one of embodiments 76-78, wherein the gNA is a single-guide gNA comprising the scaffold sequence linked to the targeting sequence.

Embodiment 80. The gNA variant of any one of embodiments 61 to 79, wherein the one or more of the improved characteristics of the CasX variant is at least about 1.1 to about 100-fold or more improved relative to the reference gNA of SEQ ID NO: 4 or SEQ ID NO: 5.

Embodiment 81. The gNA variant of any one of embodiments 61 to 79, wherein one or more of the improved characteristics of the gNA variant is at least about 1.1, at least about 2, at least about 10, or at least about 100-fold or more improved relative to the reference gNA of SEQ ID NO: 4, SEQ ID NO: 5, SEQ ID NO: 2238, SEQ ID NO: 2239, Variant Scaffold 174 (Table 2), or Variant Scaffold 175 (Table 2).

Embodiment 82. The gNA variant of any one of embodiments 61-81, comprising a scaffold region having at least 60% sequence identity to SEQ ID NO: 4 or SEQ ID NO: 5 exclusive of the extended stem region.

Embodiment 83. The gNA variant of any one of embodiments 61-81, comprising a scaffold stem loop having at least 60% sequence identity to SEQ ID NO: 14.

Embodiment 84. The gNA variant of any one of embodiments 61-81, wherein the scaffold of the gNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4, SEQ ID NO: 5, SEQ ID NO: 2238, SEQ ID NO: 2239, Variant Scaffold 174 (Table 2), or Variant Scaffold 175 (Table 2).

Embodiment 85. The gNA variant of any one of embodiments 61-81, the scaffold of the gNA variant sequence comprises a sequence selected from the group of sequences of SEQ ID NOS: 2101-2285 or 4433-4437, or having at least about 80%, at least about 90%, at least about 95%, at least about 96%, at least about 97%, at least about 98%, at least about 99% identity thereto.

Embodiment 86. The gNA variant of embodiment 85, wherein the scaffold of the gNA variant sequence consists of a sequence selected from the group of sequences of SEQ ID NOS: 2101-2285 or 4433-4437.

Embodiment 87. The gNA variant of any one of embodiments 61-86, further comprising one or more ribozymes.

Embodiment 88. The gNA variant of embodiment 87, wherein the one or more ribozymes are independently fused to a terminus of the gNA variant.

Embodiment 89. The gNA variant of embodiment 87 or embodiment 88, wherein at least one of the one or more ribozymes are an hepatitis delta virus (HDV) ribozyme, hammerhead ribozyme, pistol ribozyme, hatchet ribozyme, or tobacco ringspot virus (TRSV) ribozyme.

Embodiment 90. The gNA variant of any one of embodiments 61-89, further comprising a protein binding motif.

Embodiment 91. The gNA variant of any one of embodiments 61-90, further comprising a thermostable stem loop.

Embodiment 92. The gNA variant of any one of embodiments 61-91, wherein the gNA is chemically modified.

Embodiment 93. The gNA variant of any one of embodiments 61 to 92, wherein the gNA comprises a first region from a first gNA and a second region from a second gNA different from the first gNA.

Embodiment 94. The gNA variant of embodiment 93, wherein the first region is selected from the group consisting of a triplex region, a scaffold stem loop, and an extended stem loop.

Embodiment 95. The gNA variant of embodiment 93 or embodiment 94, wherein the second region is selected from the group consisting of a triplex region, a scaffold stem loop, and an extended stem loop.

Embodiment 96. The gNA variant of any one of embodiments 93 to 95, wherein the first and second regions are not the same region.

Embodiment 97. The gNA variant of any one of embodiments 93 to 95, wherein the first gNA comprises a sequence of SEQ ID NO: 4 and the second gNA comprises a sequence of SEQ ID NO: 5.

Embodiment 98. The gNA variant of any one of embodiments 61 to 97, comprising at least one chimeric region comprising a first part from a first gNA and a second part from a second gNA.

Embodiment 99. The gNA variant of embodiment 98, wherein the at least one chimeric region is selected from the group consisting of a triplex region, a scaffold stem loop, and an extended stem loop.

Embodiment 100. The gNA variant of embodiment 61, comprising the sequence of any one of any one of SEQ ID NOS: 2101-2285.

Embodiment 101. A gene editing pair comprising a CasX protein and a first gNA.

Embodiment 102. The gene editing pair of embodiment 101, wherein the CasX and the gNA are capable of associating together in a ribonuclear protein complex (RNP).

Embodiment 103. The gene editing pair of embodiment 101, wherein the CasX and the gNA are associated together in a ribonuclear protein complex (RNP).

Embodiment 104. The gene editing pair of any one of embodiments 101-103, wherein the first gNA comprises a gNA variant of any one of embodiments 76-100, a targeting sequence wherein the targeting sequence is complementary to the target DNA.

Embodiment 105. The gene editing pair of any one of embodiments 101-104, wherein the CasX comprises a CasX variant of any one of embodiments 1-60.

Embodiment 106. The gene editing pair of any one of embodiments 101 to 105, comprising:
 a. a gNA variant of any one of embodiments 76-100, and
 b. a CasX variant of any one of embodiments 1-60.

Embodiment 107. The gene editing pair of embodiment 106, wherein the gene editing pair of the CasX variant and the gNA variant has one or more improved characteristics compared to a gene editing pair comprising a reference CasX protein of SEQ ID NO: 1, SEQ ID NO: 2, SEQ ID NO: 3, SEQ ID NO: 270, or SEQ ID NO: 336, and a reference guide nucleic acid of SEQ ID NOS: 4, 5, 2238, or 2239.

Embodiment 108. The gene editing pair of embodiment 107, wherein the one or more improved characteristics comprises improved CasX:gNA (RNP) complex stability, improved binding affinity between the CasX and gNA, improved kinetics of RNP complex formation, higher percentage of cleavage-competent RNP, improved RNP binding affinity to a target DNA, ability to utilize an increased spectrum of PAM sequences, improved unwinding of the target DNA, increased editing activity, improved editing efficiency, improved editing specificity, increased nuclease activity, increased target strand loading for double strand cleavage, decreased target strand loading for single strand nicking, decreased off-target cleavage, improved binding of the non-target strand of DNA, or improved resistance to nuclease activity.

Embodiment 109. The gene editing pair of embodiment 107 or embodiment 108, wherein the at least one or more of the improved characteristics is at least about 1.1 to about 100-fold or more improved relative to a gene editing pair of the reference CasX protein and the reference guide nucleic acid.

Embodiment 110. The gene editing pair of embodiment 107 or 108, wherein one or more of the improved characteristics of the CasX variant is at least about 1.1, at least about 2, at least about 10, or at least about 100-fold or more improved relative to a gene editing pair of the reference CasX protein and the reference guide nucleic acid.

Embodiment 111. The gene editing pair of embodiment 107 or embodiment 108, wherein the improved characteristic comprises a 4 to 9 fold increase in editing activity compared to a reference editing pair of SEQ ID NO: 2 and SEQ ID NO: 5.

Embodiment 112. A composition comprising the gene editing pair of any one of embodiments 101-111, comprising:
 a. a second gene editing pair comprising the CasX variant of any one of embodiments 1-60; and
 b. a second gNA variant of any one of embodiments 61-100, wherein the second gNA variant has a targeting sequence complementary to a different or overlapping portion of the target DNA compared to the targeting sequence of the first gNA.

Embodiment 113. The gene editing pair of any one of embodiments 101-112, wherein the RNP of the CasX variant and the gNA variant has a higher percentage of cleavagecompetent RNP compared to an RNP of a reference CasX protein and a reference guide nucleic acid.

Embodiment 114. The gene editing pair of any one of embodiments 101-113, wherein the RNP is capable of binding and cleaving a target DNA.

Embodiment 115. The gene editing pair of any one of embodiments 101-112, wherein the RNP is capable of binding a target DNA but is not capable of cleaving the target DNA.

Embodiment 116. The gene editing pair of any one of embodiments 101-112, wherein the RNP is capable of binding a target DNA and generating one or more single-stranded nicks in the target DNA.

Embodiment 117. A CasX variant comprising the amino acid sequence of any one of SEQ ID NO: 4416-4432.

Embodiment 118. A gNA variant comprising the amino acid sequence of any one of SEQ ID NO: 4433-4437.

Set II

Embodiment 1. A variant of a reference CasX protein (CasX variant), wherein:
   a. the CasX variant comprises at least one modification in the reference CasX protein; and
   b. the CasX variant exhibits at least one improved characteristic as compared to the reference CasX protein, optionally wherein the variant comprises a sequence selected from those provided in Table 3 and 8.

Embodiment 2. The CasX variant of embodiment 1, wherein the improved characteristic of the CasX variant is selected from the group consisting of: improved folding of the CasX variant; improved binding affinity to a guide nucleic acid (gNA); improved binding affinity to a target DNA; improved ability to utilize a greater spectrum of one or more PAM sequences, including ATC, CTC, GTC, or TTC, in the editing of target DNA; improved unwinding of the target DNA; increased editing activity; improved editing efficiency; improved editing specificity; increased nuclease activity; increased target strand loading for double strand cleavage; decreased target strand loading for single strand nicking; decreased off-target cleavage; improved binding of non-target DNA strand; improved protein stability; improved protein solubility; improved protein:gNA complex (RNP) stability; improved protein:gNA complex solubility; improved protein yield; improved protein expression; improved fusion characteristics or a combination thereof.

Embodiment 3. The Cas X variant of embodiment 1 or 2, wherein the at least one modification comprises:
   a. at least one amino acid substitution in a domain of the CasX variant;
   b. at least one amino acid deletion in a domain of the CasX variant;
   c. at least one amino acid insertion in a domain of the CasX variant;
   d. a substitution of all or a portion of a domain from a different CasX;
   e. a deletion of all or a portion of a domain of the CasX variant; or
   f. any combination of (a)-(e).

Embodiment 4. The CasX variant of any one of embodiments 1-3, wherein the reference CasX protein comprises the sequence of SEQ ID NO: 1, SEQ ID NO: 2, or SEQ ID NO: 3.

Embodiment 5. The CasX variant of any one of embodiments 1-4, wherein the at least one modification is in a domain selected from:
   a. a non-target strand binding (NTSB) domain;
   b. a target strand loading (TSL) domain;
   c. a helical I domain;
   d. a helical II domain;
   e. an oligonucleotide binding domain (OBD); or
   f. a RuvC DNA cleavage domain.

Embodiment 6. The CasX variant of embodiment 5, comprising at least one modification in the NTSB domain.

Embodiment 7. The CasX variant of embodiment 5, comprising at least one modification in the TSL domain.

Embodiment 8. The CasX variant of embodiment 5, comprising at least one modification in the helical I domain.

Embodiment 9. The CasX variant of any one of embodiments 5-8, comprising at least one modification in the helical II domain.

Embodiment 10. The CasX variant of embodiment 5, comprising at least one modification in the OBD domain.

Embodiment 11. The CasX variant of embodiment 5, comprising at least one modification in the RuvC DNA cleavage domain.

Embodiment The CasX variant of any one of embodiments 5-11, wherein the modification results in an increased ability to edit the target DNA.

Embodiment 13. The CasX variant of any one of the embodiments 1 to 12, wherein the CasX variant is capable of forming a ribonuclear protein complex (RNP) with a guide nucleic acid (gNA).

Embodiment 14. The CasX variant of any one of embodiments 1 to 13, wherein the at least one modification comprises:
   a. a substitution of 1 to 100 consecutive or non-consecutive amino acids in the CasX variant;
   b. a deletion of 1 to 100 consecutive or non-consecutive amino acids in the CasX variant;
   c. an insertion of 1 to 100 consecutive or non-consecutive amino acids in the CasX; or
   d. any combination of (a)-(c).

Embodiment 15. The CasX variant of embodiment 14, wherein the at least one modification comprises:
   a. a substitution of 5-10 consecutive or non-consecutive amino acids in the CasX variant;
   b. a deletion of 1-5 consecutive or non-consecutive amino acids in the CasX variant;
   c. an insertion of 1-5 consecutive or non-consecutive amino acids in the CasX; or
   d. any combination of (a)-(c).

Embodiment 16. The CasX variant of any one of embodiments 1 to 15, wherein the CasX variant comprises two or more modifications in one domain.

Embodiment 17. The CasX variant of any one of embodiments 1 to 16, wherein the CasX variant comprises modifications in two or more domains.

Embodiment 18. The CasX variant of any one of embodiments 1-15, comprising at least one modification of a region of non-contiguous amino acid residues of the CasX variant that form a channel in which gNA:target DNA complexing with the CasX variant occurs.

Embodiment 19. The CasX variant of any one of embodiments 1-15, comprising at least one modification of a region of non-contiguous amino acid residues of the CasX variant that form an interface which binds with the gNA.

Embodiment 20. The CasX variant of any one of embodiments 1-15, comprising at least one modification of a region of non-contiguous amino acid residues of the CasX variant that form a channel which binds with the non-target strand DNA.

Embodiment 21. The CasX variant of any one of embodiments 1-15, comprising at least one modification of a region of non-contiguous amino acid residues of the CasX variant that form an interface which binds with the protospacer adjacent motif (PAM) of the target DNA.

Embodiment 22. The CasX variant of any one of embodiments 1-15, comprising at least one modification of a region of non-contiguous surface-exposed amino acid residues of the CasX variant.

Embodiment 23. The CasX variant of any one of embodiments 1-15, comprising at least one modification of a region of non-contiguous amino acid residues that form a core through hydrophobic packing in a domain of the CasX variant.

Embodiment 24. The CasX variant of any one of embodiments 18-23, wherein the modification is one or more of a deletion, an insertion, or a substitution of one or more amino acids of the region.

Embodiment 25. The CasX variant of any one of embodiments 18-23, wherein between 2 to 15 amino acid residues of the region of the CasX variant are substituted with charged amino acids.

Embodiment 26. The CasX variant of any one of embodiments 18-23, wherein between 2 to 15 amino acid residues of a region of the CasX variant are substituted with polar amino acids.

Embodiment 27. The CasX variant of any one of embodiments 18-23, wherein between 2 to 15 amino acid residues of a region of the CasX variant are substituted with amino acids that stack with DNA or RNA bases.

Embodiment 28. The CasX variant of any one of embodiments 1-5, wherein the CasX variant has a sequence selected from the group consisting of the sequences of Table 3, or a sequence having at least about 50%, at least about 60%, at least about 70%, at least about 80%, at least about 90%, or at least about 95%, or at least about 96%, or at least about 97%, or at least about 98%, or at least about 99%, sequence identity thereto.

Embodiment 29. The CasX variant of any one of embodiments 1-5, further comprising a substitution of an NTSB and/or a helical 1b domain from a different CasX.

Embodiment 30. The CasX variant of embodiment 29, wherein the substituted NTSB and/or the helical 1b domain is from the reference CasX of SEQ ID NO: 1.

Embodiment 31. The CasX variant of any one of embodiments 1 to 30, further comprising one or more nuclear localization signals (NLS).

Embodiment 32. The CasX variant of embodiment 31, wherein the one or more NLS are selected from the group of sequences consisting of PKKKRKV (SEQ ID NO: 352), KRPAATKKAGQAKKKK (SEQ ID NO: 353), PAAKRVKLD (SEQ ID NO: 354), RQRRNELKRSP (SEQ ID NO: 355), NQSSNFGPMKGGNFG-GRSSGPYGGGGQYFAKPRNQGGY (SEQ ID NO: 356), RMRIZFKNKGKDTAELRRRRVEVSVELRKAKKD-EQILKRRNV (SEQ ID NO: 357), VSRKRPRP (SEQ ID NO: 358), PPKKARED (SEQ ID NO: 350, PQPKKKPL (SEQ ID NO: 360), SALIKKKKMAP (SEQ ID NO: 361), DRLRR (SEQ ID NO: 362), PKQKKRK (SEQ ID NO: 363), RKLKKKIKKL (SEQ ID NO: 364), REKKKFLKRR (SEQ ID NO: 365), KRKGDEVDGVDEVAKKKSKK (SEQ ID NO: 366), RKCLQAGMNLEARKTKK (SEQ ID NO: 367), PRPRKIPR (SEQ ID NO: 368), PPRKKRTVV (SEQ ID NO: 369), NLSKKKKRKREK (SEQ ID NO: 370), RRPSRPFRKP (SEQ ID NO: 371), KRPRSPSS (SEQ ID NO: 372), KRGINDRNFWRGENERKTR (SEQ ID NO: 373), PRPPKMARYDN (SEQ ID NO: 374), KRSFSKAF (SEQ ID NO: 375), KLKIKRPVK (SEQ ID NO: 376), PKKKRKVPPPPAAKRVKLD (SEQ ID NO: 377), PKTRRRPRRSQRKRPPT (SEQ ID NO: 378), SRRR-KANPTKLSENAKKLAKEVEN (SEQ ID NO: 379), KTRRRPRRSQRKRPPT (SEQ ID NO: 380), RRKKRR-PRRKKRR (SEQ ID NO: 381), PKKKSRKPKKKSRK (SEQ ID NO: 382), HKKKHPDASVNFSEFSK (SEQ ID NO: 383), QRPGPYDRPQRPGPYDRP (SEQ ID NO: 384), LSPSLSPLLSPSLSPL (SEQ ID NO: 385), RGKGGKGLGKGGAKRHRK (SEQ ID NO: 386), PKR-GRGRPKRGRGR (SEQ ID NO: 387), PKKKRKVPPPPKKKRKV (SEQ ID NO: 389), PAKRARRGYKC (SEQ ID NO: 4599), KLGPRKATGRW (SEQ ID NO: 4600), PRRKREE (SEQ ID NO: 4601), PYRGRKE (SEQ ID NO: 4602), PLRKRPRR (SEQ ID NO: 4603), PLRKRPRRGSPLRKRPRR (SEQ ID NO: 4604), PAAKRVKLDGGKRTADGSEFESPKKKRKV (SEQ ID NO: 4605), PAAKRVKLDGGKRTADGSEF-ESPKKKRKVGIHGVPAA (SEQ ID NO: 4606), PAAKRVKLDGGKRTADGSEFESPKKKRK-VAEAAAKEAAAKEAAAKA (SEQ ID NO: 4607), PAAKRVKLDGGKRTADGSEFESPKKKRKVPG (SEQ ID NO: 4608), KRKGSPERGERKRHW (SEQ ID NO: 4609), KRTADSQHSTPPKTKRKVEFEPKKKRKV (SEQ ID NO: 4610), and PKKKRKVGGSKRTADSQH-STPPKTKRKVEFEPKKKRKV (SEQ ID NO: 4611).

Embodiment 33. The CasX variant of embodiment 31 or embodiment 32, wherein the one or more NLS are positioned at or near the C-terminus of the CasX protein.

Embodiment 34. The CasX variant of embodiment 31 or embodiment 32, wherein the one or more NLS are positioned at or near at the N-terminus of the CasX protein.

Embodiment 35. The CasX variant of embodiment 31 or embodiment 32, comprising at least two NLS, wherein the at least two NLS are positioned at or near the N-terminus and at or near the C-terminus of the CasX protein.

Embodiment 36. The CasX variant of any one of embodiments 2-35, wherein one or more of the improved characteristics of the CasX variant is at least about 1.1 to about 100-fold or more improved relative to the reference CasX protein of SEQ ID NO: 1, SEQ ID NO: 2, or SEQ ID NO: 3.

Embodiment 37. The CasX variant of embodiment 2-35, wherein one or more of the improved characteristics of the CasX variant is at least about 1.1, at least about 2, at least about 10, at least about 100-fold or more improved relative to the CasX protein of SEQ ID NO: 1, SEQ ID NO: 2, SEQ ID NO: 3, SEQ ID NO: 270, or SEQ ID NO: 336.

Embodiment 38. The CasX variant of any one of embodiments 2-37, wherein the improved characteristic comprises editing efficiency, and the CasX variant comprises a 1.1 to 100-fold improvement in editing efficiency compared to the CasX protein of SEQ ID NO: 270 or SEQ ID NO: 336.

Embodiment 39. The CasX variant of any one of embodiments 1 to 38, wherein the RNP comprising the CasX variant exhibits greater editing efficiency and/or binding of a target sequence in the target DNA when any one of the PAM sequences TTC, ATC, GTC, or CTC is located 1 nucleotide 5' to the non-target strand of the protospacer having identity with the targeting sequence of the gNA in a cellular assay system compared to the editing efficiency and/or binding of an RNP comprising a reference CasX protein in a comparable assay system.

Embodiment 40. The CasX variant of embodiment 39, wherein the PAM sequence is TTC.

Embodiment 41. The CasX variant of embodiment 39, wherein the PAM sequence is ATC.

Embodiment 42. The CasX variant of embodiment 39, wherein the PAM sequence is CTC.

Embodiment 43. The CasX variant of embodiment 39, wherein the PAM sequence is GTC.

Embodiment 44. The CasX variant of any one of embodiments 39, wherein the improved editing efficiency and/or binding to the target DNA of the RNP comprising the CasX variant is at least about 1.1 to about 100-fold improved relative to the RNP comprising the reference CasX.

Embodiment 45. The CasX variant of any one of embodiments 1 to 44, wherein the CasX variant comprises between 400 and 2000 amino acids.

Embodiment 46. The CasX variant of any one of embodiments 1 to 45, wherein the CasX variant protein comprises a nuclease domain having nickase activity.

Embodiment 47. The CasX variant of any one of embodiments 1-45, wherein the CasX variant protein comprises a nuclease domain having double-stranded cleavage activity.

Embodiment 48. The CasX variant of any one of embodiments 1-45, wherein the CasX protein is a catalytically inactive CasX (dCasX) protein, and wherein the dCasX and the gNA retain the ability to bind to the target DNA.

Embodiment 49. The CasX variant of embodiment 48, wherein the dCasX comprises a mutation at residues:
 a. D672, and/or E769, and/or D935 corresponding to the CasX protein of SEQ ID NO:1; or
 b. D659, and/or E756, and/or D922 corresponding to the CasX protein of SEQ ID NO: 2.

Embodiment 50. The CasX variant of embodiment 49, wherein the mutation is a substitution of alanine for the residue.

Embodiment 51. The CasX variant of any one of embodiments 1 to 50, wherein the CasX variant comprises a first domain from a first CasX protein and second domain from a second CasX protein different from the first CasX protein.

Embodiment 52. The CasX variant of embodiment 51, wherein the first domain is selected from the group consisting of the NTSB, TSL, helical I, helical II, OBD, and RuvC domains.

Embodiment 53. The CasX variant of embodiment 51, wherein the second domain is selected from the group consisting of the NTSB, TSL, helical I, helical II, OBD, and RuvC domains.

Embodiment 54. The CasX variant of any one of embodiments 51 to 53, wherein the first and second domains are not the same domain.

Embodiment 55. The CasX variant of any one of embodiments 1 to 50, wherein the CasX variant comprises at least one chimeric domain comprising a first part from a first CasX protein and a second part from a second CasX protein different from the first CasX protein.

Embodiment 56. The CasX variant of embodiment 55, wherein the at least one chimeric domain is selected from the group consisting of the NTSB, TSL, helical I, helical II, OBD, and RuvC domains.

Embodiment 57. The CasX variant of embodiment 56, wherein the at least one chimeric domain comprises a chimeric RuvC domain.

Embodiment 58. The CasX variant of any one embodiments of 1 to 57, comprising a heterologous protein or domain thereof fused to the CasX.

Embodiment 59. The CasX variant of embodiment 58, wherein the heterologous protein or domain thereof is a base editor.

Embodiment 60. The CasX variant of embodiment 59, wherein the base editor is an adenosine deaminase, a cytosine deaminase or a guanine oxidase.

Embodiment 61. A variant of a reference guide nucleic acid scaffold (gNA variant) capable of binding a reference CasX protein or a CasX variant, wherein:
 a. the gNA variant comprises at least one modification compared to the reference guide nucleic acid scaffold sequence; and
 b. the gNA variant exhibits one or more improved characteristics compared to the reference guide nucleic acid scaffold.

Embodiment 62. The gNA variant of embodiment 61, wherein the one or more improved characteristics is selected from the group consisting of: improved stability; improved solubility; improved transcription of the gNA; improved resistance to nuclease activity; increased folding rate of the gNA; decreased side product formation during folding; increased productive folding; improved binding affinity to a CasX protein; improved binding affinity to a target DNA when complexed with the CasX protein; improved gene editing when complexed with the CasX protein; improved specificity of editing when complexed with the CasX protein; and improved ability to utilize a greater spectrum of one or more PAM sequences, including ATC, CTC, GTC, or TTC, in the editing of target DNA when complexed with the CasX protein.

Embodiment 63. The gNA variant of embodiment 61 or 62, wherein the reference guide scaffold comprises a sequence selected from the group consisting of the sequences of SEQ ID NOS: 4-16.

Embodiment 64. The gNA variant of any one of embodiments 61 to 63, wherein the at least one modification comprises:
 a. at least one nucleotide substitution in a region of the gNA variant;
 b. at least one nucleotide deletion in a region of the gNA variant;
 c. at least one nucleotide insertion in a region of the gNA variant;
 d. a substitution of all or a portion of a region of the gNA variant;
 e. a deletion of all or a portion of a region of the gNA variant; or
 f. any combination of (a)-(e).

Embodiment 65. The gNA variant of embodiment 64, wherein the region of the gNA variant is selected from the group consisting of extended stem loop, scaffold stem loop, triplex, and pseudoknot.

Embodiment 66. The gNA variant of embodiment 65, wherein the scaffold stem further comprises a bubble.

Embodiment 67. The gNA variant of embodiment 65 or embodiment 66, wherein the scaffold further comprises a triplex loop region.

Embodiment 68. The gNA variant of any one of embodiments 65-67, wherein the scaffold further comprises a 5' unstructured region.

Embodiment 69. The gNA variant of any one of embodiments 64 to 68, wherein the at least one modification comprises:
 a. a substitution of 1 to 15 consecutive or non-consecutive nucleotides in the gNA variant in one or more regions;
 b. a deletion of 1 to 10 consecutive or non-consecutive nucleotides in the gNA variant in one or more regions;
 c. an insertion of 1 to 10 consecutive or non-consecutive nucleotides in the gNA variant in one or more regions;
 d. a substitution of the scaffold stem loop or the extended stem loop with an RNA stem loop sequence from a heterologous RNA source with proximal 5' and 3' ends; or
 e. any combination of (a)-(d).

Embodiment 70. The gNA variant of any one of embodiments 61-69, comprising an extended stem loop region comprising at least 10, at least 100, at least 500, at least 1000, or at least 10,000 nucleotides.

Embodiment 71. The gNA variant of embodiment 69, wherein the heterologous RNA stem loop sequence increases the stability of the gNA.

Embodiment 72. The gNA variant of embodiment 71, wherein the heterologous RNA stem loop is capable of binding a protein, an RNA structure, a DNA sequence, or a small molecule.

Embodiment 73. The gNA variant of embodiment 71 or embodiment 72, wherein the heterologous RNA stem loop sequence is selected from MS2, Qβ, U1 hairpin II, Uvsx, or PP7 stem loops.

Embodiment 74. The gNA variant of any one of embodiments 61-73, the gNA variant comprises two or more modifications in one region.

Embodiment 75. The gNA variant of any one of embodiments 61-74, wherein the gNA variant comprises modifications in two or more regions.

Embodiment 76. The gNA variant of any one of embodiments 61-75, wherein the gNA variant further comprises a targeting sequence wherein the targeting sequence is complementary to the target DNA sequence.

Embodiment 77. The gNA variant of embodiment 76, wherein the targeting sequence has 14, 15, 16, 17, 18, 19, 20, 21, 22, 23, 24, 25, 26, 27, 28, 29, 30, 31, 32, 33, 34 or 35 nucleotides.

Embodiment 78. The gNA variant of any one of embodiments 76 or embodiment 77, wherein the targeting sequence has 20 nucleotides.

Embodiment 79. The gNA variant of any one of embodiments 76-78, wherein the gNA is a single-guide gNA comprising the scaffold sequence linked to the targeting sequence.

Embodiment 80. The gNA variant of any one of embodiments 61 to 79, wherein the one or more of the improved characteristics of the CasX variant is at least about 1.1 to about 100-fold or more improved relative to the reference gNA of SEQ ID NO: 4 or SEQ ID NO: 5.

Embodiment 81. The gNA variant of any one of embodiments 61 to 79, wherein one or more of the improved characteristics of the gNA variant is at least about 1.1, at least about 2, at least about 10, or at least about 100-fold or more improved relative to the reference gNA of SEQ ID NO: 4, reference gNA of SEQ ID NO: 5, variant scaffold SEQ ID NO: 2238, or variant scaffold SEQ ID NO: 2239.

Embodiment 82. The gNA variant of any one of embodiments 61-81, comprising a scaffold region having at least 60% sequence identity to SEQ ID NO: 4 or SEQ ID NO: 5 exclusive of the extended stem region.

Embodiment 83. The gNA variant of any one of embodiments 61-81, comprising a scaffold stem loop having at least 60% sequence identity to SEQ ID NO: 14.

Embodiment 84. The gNA variant of any one of embodiments 61-81, wherein the scaffold of the gNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4, SEQ ID NO: 5, SEQ ID NO: 2238, or SEQ ID NO: 2239.

Embodiment 85. The gNA variant of any one of embodiments 61-81, the scaffold of the gNA variant sequence comprises a sequence selected from the group of sequences of SEQ ID NOS: 2101-2280, or 4433-4446, or having at least about 80%, at least about 90%, at least about 95%, at least about 96%, at least about 97%, at least about 98%, at least about 99% identity thereto.

Embodiment 86. The gNA variant of embodiment 85, wherein the scaffold of the gNA variant sequence consists of a sequence selected from the group of sequences of SEQ ID NOS: 2101-2280, or 4433-4446.

Embodiment 87. The gNA variant of any one of embodiments 61-86, further comprising one or more ribozymes.

Embodiment 88. The gNA variant of embodiment 87, wherein the one or more ribozymes are independently fused to a terminus of the gNA variant.

Embodiment 89. The gNA variant of embodiment 87 or embodiment 88, wherein at least one of the one or more ribozymes are an hepatitis delta virus (HDV) ribozyme, hammerhead ribozyme, pistol ribozyme, hatchet ribozyme, or tobacco ringspot virus (TRSV) ribozyme.

Embodiment 90. The gNA variant of any one of embodiments 61-89, further comprising a protein binding motif.

Embodiment 91. The gNA variant of any one of embodiments 61-90, further comprising a thermostable stem loop.

Embodiment 92. The gNA variant of any one of embodiments 61-91, wherein the gNA is chemically modified.

Embodiment 93. The gNA variant of any one of embodiments 61 to 92, wherein the gNA comprises a first region from a first gNA and a second region from a second gNA different from the first gNA.

Embodiment 94. The gNA variant of embodiment 93, wherein the first region is selected from the group consisting of a triplex region, a scaffold stem loop, and an extended stem loop.

Embodiment 95. The gNA variant of embodiment 93 or embodiment 94, wherein the second region is selected from the group consisting of a triplex region, a scaffold stem loop, and an extended stem loop.

Embodiment 96. The gNA variant of any one of embodiments 93 to 95, wherein the first and second regions are not the same region.

Embodiment 97. The gNA variant of any one of embodiments 93 to 95, wherein the first gNA comprises a sequence of SEQ ID NO: 4 and the second gNA comprises a sequence of SEQ ID NO: 5.

Embodiment 98. The gNA variant of any one of embodiments 61 to 97, comprising at least one chimeric region comprising a first part from a first gNA and a second part from a second gNA.

Embodiment 99. The gNA variant of embodiment 98, wherein the at least one chimeric region is selected from the group consisting of a triplex region, a scaffold stem loop, and an extended stem loop.

Embodiment 100. The gNA variant of embodiment 61, comprising the sequence of any one of any one of SEQ ID NOS: 2101-2280, or 4433-4446.

Embodiment 101. A gene editing pair comprising a CasX protein and a first gNA.

Embodiment 102. The gene editing pair of embodiment 101, wherein the CasX and the gNA are capable of associating together in a ribonuclear protein complex (RNP).

Embodiment 103. The gene editing pair of embodiment 101, wherein the CasX and the gNA are associated together in a ribonuclear protein complex (RNP).

Embodiment 104. The gene editing pair of any one of embodiments 101-103, wherein the first gNA comprises a gNA variant of any one of embodiments 76-100, a targeting sequence wherein the targeting sequence is complementary to the target DNA.

Embodiment 105. The gene editing pair of any one of embodiments 101-104, wherein the CasX comprises a CasX variant of any one of embodiments 1-60.

Embodiment 106. The gene editing pair of any one of embodiments 101 to 105, comprising:
  a. a gNA variant of any one of embodiments 76-100, and
  b. a CasX variant of any one of embodiments 1-60.

Embodiment 107. The gene editing pair of embodiment 106, wherein the gene editing pair of the CasX variant and the gNA variant has one or more improved characteristics compared to a gene editing pair comprising a reference CasX protein of SEQ ID NO: 1, SEQ ID NO: 2, or SEQ ID NO: 3, and a reference guide nucleic acid of SEQ ID NOS: 4 or 5.

Embodiment 108. The gene editing pair of embodiment 107, wherein the one or more improved characteristics comprises improved CasX:gNA (RNP) complex stability, improved binding affinity between the CasX and gNA, improved kinetics of RNP complex formation, higher percentage of cleavage-competent RNP, improved RNP binding affinity to a target DNA, ability to utilize an increased spectrum of PAM sequences, improved unwinding of the target DNA, increased editing activity, improved editing efficiency, improved editing specificity, increased nuclease activity, increased target strand loading for double strand cleavage, decreased target strand loading for single strand nicking, decreased off-target cleavage, improved binding of the non-target strand of DNA, or improved resistance to nuclease activity.

Embodiment 109. The gene editing pair of embodiment 107 or embodiment 108, wherein the at least one or more of the improved characteristics is at least about 1.1 to about 100-fold or more improved relative to a gene editing pair of the reference CasX protein and the reference guide nucleic acid.

Embodiment 110. The gene editing pair of embodiment 107 or embodiment 108, wherein one or more of the improved characteristics of the CasX variant is at least about 1.1, at least about 2, at least about 10, or at least about 100-fold or more improved relative to a gene editing pair of the reference CasX protein and the reference guide nucleic acid.

Embodiment 111. The gene editing pair of embodiment 107 or embodiment 108, wherein the improved characteristic comprises a 4 to 9 fold increase in editing activity compared to a reference editing pair of SEQ ID NO: 2 and SEQ ID NO: 5.

Embodiment 112. A composition comprising the gene editing pair of any one of embodiments 101-111, comprising:
  a. a second gene editing pair comprising the CasX variant of any one of embodiments 1-60; and
  b. a second gNA variant of any one of embodiments 61-100, wherein the second gNA variant has a targeting sequence complementary to a different or overlapping portion of the target DNA compared to the targeting sequence of the first gNA.

Embodiment 113. The gene editing pair of any one of embodiments 101-112, wherein the RNP of the CasX variant and the gNA variant has a higher percentage of cleavage-competent RNP compared to an RNP of a reference CasX protein and a reference guide nucleic acid.

Embodiment 114. The gene editing pair of any one of embodiments 101-113, wherein the RNP is capable of binding and cleaving a target DNA.

Embodiment 115. The gene editing pair of any one of embodiments 101-112, wherein the RNP is capable of binding a target DNA but is not capable of cleaving the target DNA.

Embodiment 116. The gene editing pair of any one of embodiments 101-112, wherein the RNP is capable of binding a target DNA and generating one or more single-stranded nicks in the target DNA.

Embodiment 117. A CasX variant comprising the amino acid sequence of any one of SEQ ID NO: 4416-4432 or 4597-4598.

Embodiment 118. A gNA variant comprising the amino acid sequence of any one of SEQ ID NO: 4433-4446.

Set III

Embodiment 1. A variant of a reference CasX protein (CasX variant), wherein:
  a. the CasX variant comprises at least one modification in the reference CasX protein; and
  b. the CasX variant exhibits at least one improved characteristic as compared to the reference CasX protein,
  optionally wherein the variant comprises a sequence selected from the group consisting of SEQ ID NOS: 89-101, 247-337, 411-592, and 760-982.

Embodiment 2. The CasX variant of embodiment 1, wherein the improved characteristic of the CasX variant is selected from the group consisting of: improved folding of the CasX variant; improved binding affinity to a guide nucleic acid (gNA); improved binding affinity to a target nucleic acid; improved ability to utilize a greater spectrum of one or more PAM sequences, including ATC, CTC, GTC, or TTC, in the editing of target nucleic acid; improved unwinding of the target nucleic acid; increased editing activity; improved editing efficiency; improved editing specificity; increased nuclease activity; increased target strand loading for double strand cleavage; decreased target strand loading for single strand nicking; decreased off-target cleavage; improved binding of non-target nucleic acid strand; improved protein stability; improved protein solubility; improved protein:gNA complex (RNP) stability; improved protein:gNA complex solubility; improved protein yield; improved protein expression; improved fusion characteristics or a combination thereof.

Embodiment 3. The Cas X variant of embodiment 1 or 2, wherein the at least one modification comprises:
  a. at least one amino acid substitution in a domain of the CasX variant;
  b. at least one amino acid deletion in a domain of the CasX variant;
  c. at least one amino acid insertion in a domain of the CasX variant;
  d. a substitution of all or a portion of a domain from a different CasX;
  e. a deletion of all or a portion of a domain of the CasX variant; or
  f. any combination of (a)-(e).

Embodiment 4. The CasX variant of any one of embodiments 1-3, wherein the reference CasX protein comprises the sequence of SEQ ID NO: 1, SEQ ID NO: 2, or SEQ ID NO: 3.

Embodiment 5. The CasX variant of any one of embodiments 1-4, wherein the at least one modification is in a domain selected from:
  a. a non-target strand binding (NTSB) domain;
  b. a target strand loading (TSL) domain;
  c. a helical I domain;
  d. a helical II domain;
  e. an oligonucleotide binding domain (OBD); or
  f. a RuvC DNA cleavage domain.

Embodiment 6. The CasX variant of embodiment 5, comprising at least one modification in the NTSB domain.

Embodiment 7. The CasX variant of embodiment 5, comprising at least one modification in the TSL domain.

Embodiment 8. The CasX variant of embodiment 5, comprising at least one modification in the helical I domain.

Embodiment 9. The CasX variant of any one of embodiments 5-8, comprising at least one modification in the helical II domain.

Embodiment 10. The CasX variant of embodiment 5, comprising at least one modification in the OBD domain.

Embodiment 11. The CasX variant of embodiment 5, comprising at least one modification in the RuvC DNA cleavage domain.

Embodiment 12. The CasX variant of any one of embodiments 5-11, wherein the modification results in an increased ability to edit the target nucleic acid.

Embodiment 13. The CasX variant of any one of the embodiments 1 to 12, wherein the CasX variant is capable of forming a ribonuclear protein complex (RNP) with a guide nucleic acid (gNA).

Embodiment 14. The CasX variant of any one of embodiments 1 to 13, wherein the at least one modification comprises:
   a. a substitution of 1 to 100 consecutive or non-consecutive amino acids in the CasX variant;
   b. a deletion of 1 to 100 consecutive or non-consecutive amino acids in the CasX variant;
   c. an insertion of 1 to 100 consecutive or non-consecutive amino acids in the CasX; or
   d. any combination of (a)-(c).

Embodiment 15. The CasX variant of embodiment 14, wherein the at least one modification comprises:
   a. a substitution of 5-10 consecutive or non-consecutive amino acids in the CasX variant;
   b. a deletion of 1-5 consecutive or non-consecutive amino acids in the CasX variant;
   c. an insertion of 1-5 consecutive or non-consecutive amino acids in the CasX; or
   d. any combination of (a)-(c).

Embodiment 16. The CasX variant of any one of embodiments 1 to 15, wherein the CasX variant comprises two or more modifications in one domain.

Embodiment 17. The CasX variant of any one of embodiments 1 to 16, wherein the CasX variant comprises modifications in two or more domains.

Embodiment 18. The CasX variant of any one of embodiments 1-15, comprising at least one modification of a region of non-contiguous amino acid residues of the CasX variant that form a channel in which gNA:target nucleic acid complexing with the CasX variant occurs.

Embodiment 19. The CasX variant of any one of embodiments 1-15, comprising at least one modification of a region of non-contiguous amino acid residues of the CasX variant that form an interface which binds with the gNA.

Embodiment 20. The CasX variant of any one of embodiments 1-15, comprising at least one modification of a region of non-contiguous amino acid residues of the CasX variant that form a channel which binds with the non-target strand DNA.

Embodiment 21. The CasX variant of any one of embodiments 1-15, comprising at least one modification of a region of non-contiguous amino acid residues of the CasX variant that form an interface which binds with the protospacer adjacent motif (PAM) of the target nucleic acid.

Embodiment 22. The CasX variant of any one of embodiments 1-15, comprising at least one modification of a region of non-contiguous surface-exposed amino acid residues of the CasX variant.

Embodiment 23. The CasX variant of any one of embodiments 1-15, comprising at least one modification of a region of non-contiguous amino acid residues that form a core through hydrophobic packing in a domain of the CasX variant.

Embodiment 24. The CasX variant of any one of embodiments 18-23, wherein the modification is one or more of a deletion, an insertion, or a substitution of one or more amino acids of the region.

Embodiment 25. The CasX variant of any one of embodiments 18-23, wherein between 2 to 15 amino acid residues of the region of the CasX variant are substituted with charged amino acids.

Embodiment 26. The CasX variant of any one of embodiments 18-23, wherein between 2 to 15 amino acid residues of a region of the CasX variant are substituted with polar amino acids.

Embodiment 27. The CasX variant of any one of embodiments 18-23, wherein between 2 to 15 amino acid residues of a region of the CasX variant are substituted with amino acids that stack with DNA or RNA bases.

Embodiment 28. The CasX variant of any one of embodiments 1-5, further comprising a substitution of an NTSB and/or a helical 1b domain from a different CasX.

Embodiment 29. The CasX variant of embodiment 28, wherein the substituted NTSB and/or the helical 1b domain is from the reference CasX of SEQ ID NO: 1.

Embodiment 30. The CasX variant of any one of embodiments 1-29, wherein the CasX variant has a sequence selected from the group consisting of SEQ ID NOS: 89-101, 247-337, 411-592, and 760-982, or a sequence having at least about 50%, at least about 60%, at least about 70%, at least about 80%, at least about 90%, or at least about 95%, or at least about 96%, or at least about 97%, or at least about 98%, or at least about 99%, sequence identity thereto.

Embodiment 31. The CasX variant of any one of embodiments 1 to 30, further comprising one or more nuclear localization signals (NLS).

Embodiment 32. The CasX variant of embodiment 31, wherein the one or more NLS are selected from the group of sequences consisting of PKKKRKV (SEQ ID NO: 352), KRPAATKKAGQAKKKK (SEQ ID NO: 353), PAAKRVKLD (SEQ ID NO: 354), RQRRNELKRSP (SEQ ID NO: 355), NQSSNFGPMKGGNFG-GRSSGPYGGGGQYFAKPRNQGGY (SEQ ID NO: 356), RMRIZFKNKGKDTAELRRRRVEVSVELRKAKKD-EQILKRRNV (SEQ ID NO: 357), VSRKRPRP (SEQ ID NO: 358), PPKKARED (SEQ ID NO: (359), PQPKKKPL (SEQ ID NO: 360), SALIKKKKKMAP (SEQ ID NO: 361), DRLRR (SEQ ID NO: 362), PKQKKRK (SEQ ID NO: 363), RKLKKKIKKL (SEQ ID NO: 364), REKKKFLKRR (SEQ ID NO: 365), KRKGDEVDGVDEVAKKKSKK (SEQ ID NO: 366), RKCLQAGMNLEARKTKK (SEQ ID NO: 367), PRPRKIPR (SEQ ID NO: 368), PPRKKRTVV (SEQ ID NO: 369), NLSKKKKRKREK (SEQ ID NO: 370), RRPSRPFRKP (SEQ ID NO: 371), KRPRSPSS (SEQ ID NO: 372), KRGINDRNFWRGENERKTR (SEQ ID NO: 373), PRPPKMARYDN (SEQ ID NO: 374), KRSFSKAF (SEQ ID NO: 375), KLKIKRPVK (SEQ ID NO: 376), PKKKRKVPPPPAAKRVKLD (SEQ ID NO: 377), PKTRRRPRRSQRKRPPT (SEQ ID NO: 378), SRRR-KANPTKLSENAKKLAKEVEN (SEQ ID NO: 379), KTRRRPRRSQRKRPPT (SEQ ID NO: 380), RRKKRR- PRRKKRR (SEQ ID NO: 381), PKKKSRKPKKKSRK (SEQ ID NO: 382), HKKKHPDASVNFSEFSK (SEQ ID NO: 383), QRPGPYDRPQRPGPYDRP (SEQ ID NO: 384), LSPSLSPLLSPSLSPL (SEQ ID NO: 385), RGKGGKGLGKGGAKRHRK (SEQ ID NO: 386), PKRGRGRPKRGRGR (SEQ ID NO: 387), PKKKRKVPPPPKKKRKV (SEQ ID NO: 389), PAKRARRGYKC (SEQ ID NO: 63), KLGPRKATGRW (SEQ ID NO: 64), PRRKREE (SEQ ID NO: 65), PYRGRKE (SEQ ID NO: 66), PLRKRPRR (SEQ ID NO: 67), PLRKRPRRGSPLRKRPRR (SEQ ID NO:68), PAAKRVKLDGGKRTADGSEFESPKKKRKV (SEQ ID NO:69), PAAKRVKLDGGKRTADGSEFESPKKKRKVGIHGVPAA (SEQ ID NO:70), PAAKRVKLDGGKRTADGSEFESPKKKRKVAEAAAKEAAAKEAAAKA (SEQ ID NO:71), PAAKRVKLDGGKRTADGSEFESPKKKRKVPG (SEQ ID NO:72), KRKGSPERGERKRHW (SEQ ID NO:73), KRTADSQHSTPPKTKRKVEFEPKKKRKV (SEQ ID NO:74), and PKKKRKVGGSKRTADSQHSTPPKTKRKVEFEPKKKRKV (SEQ ID NO:75) and, optionally, the one or more NLS are linked to the CasX variant or to adjacent NLS with a linker peptide wherein the linker peptide is selected from the group consisting of (G)n (SEQ ID NO: 1023), (GS)n (SEQ ID NO: 1024), (GSGGS)n (SEQ ID NO: 399), (GGSGGS)n (SEQ ID NO: 400), (GGGS)n (SEQ ID NO: 401), GGSG (SEQ ID NO: 402), GGSGG (SEQ ID NO: 403), GSGSG (SEQ ID NO: 404), GSGGG (SEQ ID NO: 405), GGGSG (SEQ ID NO: 406), GSSSG (SEQ ID NO: 407), GPGP (SEQ ID NO: 408), GGP, PPP, PPAPPA (SEQ ID NO: 409), PPPG (SEQ ID NO: 24), PPPGPPP (SEQ ID NO: 410), PPP(GGGS)n (SEQ ID NO: 25), (GGGS)nPPP (SEQ ID NO: 26), AEAAAKEAAAKEAAAKA (SEQ ID NO: 1025), and TPPKTKRKVEFE (SEQ ID NO: 27), where n is 1 to 5.

Embodiment 33. The CasX variant of embodiment 31 or embodiment 32, wherein the one or more NLS are positioned at or near the C-terminus of the CasX protein.

Embodiment 34. The CasX variant of embodiment 31 or embodiment 32, wherein the one or more NLS are positioned at or near at the N-terminus of the CasX protein.

Embodiment 35. The CasX variant of embodiment 31 or embodiment 32, comprising at least two NLS, wherein the at least two NLS are positioned at or near the N-terminus and at or near the C-terminus of the CasX protein.

Embodiment 36. The CasX variant of any one of embodiments 2-35, wherein one or more of the improved characteristics of the CasX variant is at least about 1.1 to about 100-fold or more improved relative to the reference CasX protein of SEQ ID NO: 1, SEQ ID NO: 2, or SEQ ID NO: 3, when compared in an in vitro assay under comparable conditions.

Embodiment 37. The CasX variant of embodiment 2-35, wherein one or more of the improved characteristics of the CasX variant is at least about 1.1, at least about 2, at least about 10, at least about 100-fold or more improved relative to the CasX protein of SEQ ID NO: 1, SEQ ID NO: 2, SEQ ID NO: 3, SEQ ID NO: 270, or SEQ ID NO: 336, when compared in an in vitro assay under comparable conditions.

Embodiment 38. The CasX variant of any one of embodiments 2-37, wherein the improved characteristic comprises editing efficiency, and the CasX variant comprises a 1.1 to 100-fold improvement in editing efficiency of the target nucleic acid compared to the CasX protein of SEQ ID NO: 270 or SEQ ID NO: 336, when compared in an in vitro assay under comparable conditions.

Embodiment 39. The CasX variant of any one of embodiments 1 to 38, wherein an RNP comprising the CasX variant exhibits greater editing efficiency and/or binding of a sequence in the target nucleic acid when any one of the PAM sequences TTC, ATC, GTC, or CTC is located 1 nucleotide 5' to the non-target strand of the protospacer having identity with the targeting sequence of the gNA in an in vitro cellular assay system compared to the editing efficiency and/or binding of an RNP comprising a reference CasX protein in a comparable assay system.

Embodiment 40. The CasX variant of embodiment 39, wherein the PAM sequence is TTC.

Embodiment 41. The CasX variant of embodiment 39, wherein the PAM sequence is ATC.

Embodiment 42. The CasX variant of embodiment 39, wherein the PAM sequence is CTC.

Embodiment 43. The CasX variant of embodiment 39, wherein the PAM sequence is GTC.

Embodiment 44. The CasX variant of any one of embodiments 39-43, wherein the improved editing efficiency and/or binding to the target nucleic acid by the RNP comprising the CasX variant is at least about 1.1 to about 100-fold improved relative to the RNP comprising the reference CasX.

Embodiment 45. The CasX variant of any one of embodiments 1 to 44, wherein the CasX variant comprises between 400 and 2000 amino acids.

Embodiment 46. The CasX variant of any one of embodiments 1 to 45, wherein the CasX variant protein comprises a nuclease domain having nickase activity.

Embodiment 47. The CasX variant of any one of embodiments 1-45, wherein the CasX variant protein comprises a nuclease domain having double-stranded cleavage activity.

Embodiment 48. The CasX variant of any one of embodiments 1-37, wherein the CasX protein is a catalytically inactive CasX (dCasX) protein, and wherein the dCasX and the gNA retain the ability to bind to the target nucleic acid, and optionally wherein the dCasX protein comprises a sequence of SEQ ID NOS: 44-62.

Embodiment 49. The CasX variant of embodiment 48, wherein the dCasX comprises a mutation at residues:
 a. D672, and/or E769, and/or D935 corresponding to the CasX protein of SEQ ID NO:1; or
 b. D659, and/or E756, and/or D922 corresponding to the CasX protein of SEQ ID NO: 2.

Embodiment 50. The CasX variant of embodiment 49, wherein the mutation is a substitution of alanine for the residue.

Embodiment 51. The CasX variant of any one of embodiments 1 to 50, wherein the CasX variant comprises a first domain from a first CasX protein and second domain from a second CasX protein different from the first CasX protein.

Embodiment 52. The CasX variant of embodiment 51, wherein the first domain is selected from the group consisting of the NTSB, TSL, helical I, helical II, OBD, and RuvC domains.

Embodiment 53. The CasX variant of embodiment 51, wherein the second domain is selected from the group consisting of the NTSB, TSL, helical I, helical II, OBD, and RuvC domains.

Embodiment 54. The CasX variant of any one of embodiments 51 to 53, wherein the first and second domains are not the same domain.

Embodiment 55. The CasX variant of any one of embodiments 1 to 50, wherein the CasX variant comprises at least one chimeric domain comprising a first part from a first CasX protein and a second part from a second CasX protein different from the first CasX protein.

Embodiment 56. The CasX variant of embodiment 55, wherein the at least one chimeric domain is selected from the group consisting of the NTSB, TSL, helical I, helical II, OBD, and RuvC domains.

Embodiment 57. The CasX variant of embodiment 56, wherein the at least one chimeric domain comprises a chimeric RuvC domain.

Embodiment 58. The CasX variant of any one of embodiments of 1 to 57, comprising a heterologous protein or domain thereof fused to the CasX.

Embodiment 59. The CasX variant of embodiment 58, wherein the heterologous protein or domain thereof is a base editor.

Embodiment 60. The CasX variant of embodiment 59, wherein the base editor is an adenosine deaminase, a cytosine deaminase or a guanine oxidase.

Embodiment 61. A variant of a reference guide nucleic acid scaffold (gNA variant) capable of binding a reference CasX protein or a CasX variant, wherein:
  a. the gNA variant comprises at least one modification compared to the reference guide nucleic acid scaffold sequence; and
  b. the gNA variant exhibits one or more improved characteristics compared to the reference guide nucleic acid scaffold, optionally wherein the variant comprises a sequence selected from the group consisting of SEQ ID NOS: 2101-2332.

Embodiment 62. The gNA variant of embodiment 61, wherein the one or more improved characteristics is selected from the group consisting of: improved stability; improved solubility; improved transcription of the gNA; improved resistance to nuclease activity; increased folding rate of the gNA; decreased side product formation during folding; increased productive folding; improved binding affinity to a CasX protein; improved binding affinity to a target nucleic acid when complexed with the CasX protein; improved gene editing when complexed with the CasX protein; improved specificity of editing when complexed with the CasX protein; and improved ability to form cleavage competent RNP when complexed with the CasX protein.

Embodiment 63. The gNA variant of embodiment 61 or 62, wherein the reference guide scaffold comprises a sequence selected from the group consisting of the sequences of SEQ ID NOS: 4-16.

Embodiment 64. The gNA variant of any one of embodiments 61 to 63, wherein the at least one modification comprises:
  a. at least one nucleotide substitution in a region of the gNA variant;
  b. at least one nucleotide deletion in a region of the gNA variant;
  c. at least one nucleotide insertion in a region of the gNA variant;
  d. a substitution of all or a portion of a region of the gNA variant;
  e. a deletion of all or a portion of a region of the gNA variant; or
  f. any combination of (a)-(e).

Embodiment 65. The gNA variant of embodiment 64, wherein the region of the gNA variant is selected from the group consisting of extended stem loop, scaffold stem loop, triplex, and pseudoknot.

Embodiment 66. The gNA variant of embodiment 65, wherein the scaffold stem further comprises a bubble.

Embodiment 67. The gNA variant of embodiment 65 or embodiment 66, wherein the scaffold further comprises a triplex loop region.

Embodiment 68. The gNA variant of any one of embodiments 65-67, wherein the scaffold further comprises a 5' unstructured region.

Embodiment 69. The gNA variant of any one of embodiments 64 to 68, wherein the at least one modification comprises:
  a. a substitution of 1 to 15 consecutive or non-consecutive nucleotides in the gNA variant in one or more regions;
  b. a deletion of 1 to 10 consecutive or non-consecutive nucleotides in the gNA variant in one or more regions;
  c. an insertion of 1 to 10 consecutive or non-consecutive nucleotides in the gNA variant in one or more regions;
  d. a substitution of or insertion into the scaffold stem loop or the extended stem loop with an RNA stem loop sequence from a heterologous RNA source with proximal 5' and 3' ends; or
  e. any combination of (a)-(d).

Embodiment 70. The gNA variant of any one of embodiments 61-69, the gNA variant comprises two or more modifications in one region.

Embodiment 71. The gNA variant of any one of embodiments 61-69, wherein the gNA variant comprises modifications in two or more regions.

Embodiment 72. The gNA variant of any one of embodiments 61-71, comprising an extended stem loop region comprising at least 10, at least 100, at least 500, at least 1000, or at least 10,000 nucleotides.

Embodiment 73. The gNA variant of embodiment 72, wherein the heterologous RNA stem loop sequence increases the stability of the gNA.

Embodiment 74. The gNA variant of embodiment 72 or embodiment 73, wherein the heterologous RNA stem loop is capable of binding a protein, an RNA structure, a DNA sequence, or a small molecule.

Embodiment 75. The gNA variant of embodiment 74, wherein the heterologous RNA stem loop sequence inserted in the extended stem loop is selected from MS2 hairpin, Qβ hairpin, U1 hairpin II, Uvsx hairpin, or PP7 hairpin, wherein the heterologous stem loop is capable of binding MS2 coat protein, Qβ coat protein, U1A signal recognition particle, Uvsx protein of T4 phage, or PP7 coat protein, respectively.

Embodiment 76. The gNA variant of any one of embodiments 61-75, wherein the modification comprises an insertion in the extended stem loop of one or more components selected from the group consisting of:
  a. Stem IIB of Rev response element (RRE),
  b. Stem II-V of RRE;
  c. Stem II of RRE;
  d. Rev-binding element (RBE) of Stem IIB; and
  e. and full-length RRE,
  wherein the one or more components are capable of binding Rev.

Embodiment 77. The gNA variant of any one of embodiments 61-76, wherein the gNA variant further comprises a targeting sequence, wherein the targeting sequence is complementary to the target nucleic acid sequence.

Embodiment 78. The gNA variant of embodiment 77, wherein the targeting sequence has 14, 15, 16, 17, 18, 19, 20, 21, 22, 23, 24, 25, 26, 27, 28, 29, 30, 31, 32, 33, 34 or 35 nucleotides.

Embodiment 79. The gNA variant of embodiment 78, wherein the targeting sequence has 18, 19, or 20 nucleotides.

Embodiment 80. The gNA variant of embodiment 79, wherein an RNP comprising the gNA variant having a targeting sequence of 18 nucleotides exhibits greater editing efficiency of at least 2-fold, at least 3-fold, or at least 4-fold compared to an RNP comprising the gNA variant having a targeting sequence of 20 nucleotides, when assayed in an in vitro cell-based assay under comparable conditions.

Embodiment 81. The gNA variant of embodiment 79, wherein an RNP comprising the gNA variant having a targeting sequence of 19 nucleotides exhibits greater editing efficiency of at least 2-fold, at least 3-fold, or at least 4-fold compared to an RNP comprising the gNA variant having a targeting sequence of 20 nucleotides, when assayed in an in vitro cell-based assay under comparable conditions.

Embodiment 82. The gNA variant of any one of embodiments 77-79 or, wherein the targeting sequence has 20 nucleotides.

Embodiment 83. The gNA variant of any one of embodiments 77-80, wherein the gNA is a single-guide gNA comprising the scaffold sequence linked to the targeting sequence.

Embodiment 84. The gNA variant of any one of embodiments 61 to 83, wherein the one or more of the improved characteristics of the gNA variant is at least about 1.1 to about 100-fold or more improved relative to the reference gNA of SEQ ID NO: 4 or SEQ ID NO: 5.

Embodiment 85. The gNA variant of any one of embodiments 61 to 83, wherein one or more of the improved characteristics of the gNA variant is at least about 1.1, at least about 2, at least about 10, or at least about 100-fold or more improved relative to the reference gNA of SEQ ID NO: 4, reference gNA of SEQ ID NO: 5, variant scaffold SEQ ID NO: 2238, variant scaffold SEQ ID NO: 2239, Variant Scaffold 174 (SEQ ID NO: 2238), or Variant Scaffold 175 (SEQ ID NO: 2239).

Embodiment 86. The gNA variant of any one of embodiments 61-85, comprising a scaffold region having at least 60% sequence identity to SEQ ID NO: 4 or SEQ ID NO: 5 exclusive of the extended stem region.

Embodiment 87. The gNA variant of any one of embodiments 61-85, comprising a scaffold stem loop having at least 60% sequence identity to SEQ ID NO: 14.

Embodiment 88. The gNA variant of any one of embodiments 61-85, wherein the scaffold of the gNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4, SEQ ID NO: 5, SEQ ID NO: 2238, or SEQ ID NO: 2239.

Embodiment 89. The gNA variant of any one of embodiments 61-85, wherein the scaffold of the gNA variant sequence comprises a sequence selected from the group of sequences of SEQ ID NOS: 2101-2332, or a sequence having at least about 80%, at least about 90%, at least about 95%, at least about 96%, at least about 97%, at least about 98%, at least about 99% identity thereto.

Embodiment 90. The gNA variant of embodiment 89, wherein the scaffold of the gNA variant sequence consists of a sequence selected from the group consisting of SEQ ID NOS: 2101-2332.

Embodiment 91. The gNA variant of any one of embodiments 61-90, further comprising one or more ribozymes.

Embodiment 92. The gNA variant of embodiment 91, wherein the one or more ribozymes are independently fused to a terminus of the gNA variant.

Embodiment 93. The gNA variant of embodiment 91 or embodiment 92, wherein at least one of the one or more ribozymes are an hepatitis delta virus (HDV) ribozyme, hammerhead ribozyme, pistol ribozyme, hatchet ribozyme, or tobacco ringspot virus (TRSV) ribozyme.

Embodiment 94. The gNA variant of any one of embodiments 61-93, further comprising a thermostable stem loop.

Embodiment 95. The gNA variant of any one of embodiments 61-94, wherein the gNA is chemically modified.

Embodiment 96. The gNA variant of any one of embodiments 61 to 95, wherein the gNA comprises a first region from a first gNA and a second region from a second gNA different from the first gNA.

Embodiment 97. The gNA variant of embodiment 96, wherein the first region is selected from the group consisting of a triplex region, a scaffold stem loop, and an extended stem loop.

Embodiment 98. The gNA variant of embodiment 96 or embodiment 97, wherein the second region is selected from the group consisting of a triplex region, a scaffold stem loop, and an extended stem loop.

Embodiment 99. The gNA variant of any one of embodiments 96 to 98, wherein the first and second regions are not the same region.

Embodiment 100. The gNA variant of any one of embodiments 96 to 98, wherein the first gNA comprises a sequence of SEQ ID NO: 4 and the second gNA comprises a sequence of SEQ ID NO: 5.

Embodiment 101. The gNA variant of any one of embodiments 61 to 100, comprising at least one chimeric region comprising a first part from a first gNA and a second part from a second gNA.

Embodiment 102. The gNA variant of embodiment 101, wherein the at least one chimeric region is selected from the group consisting of a triplex region, a scaffold stem loop, and an extended stem loop.

Embodiment 103. The gNA variant of embodiment 61, comprising a sequence of any one of any one of SEQ ID NOS: 2101-2332.

Embodiment 104. A gene editing pair comprising a CasX variant protein and a first gNA variant.

Embodiment 105. The gene editing pair of embodiment 104, wherein the CasX variant protein and the gNA variant are capable of associating together in a ribonuclear protein complex (RNP).

Embodiment 106. The gene editing pair of embodiment 104, wherein the CasX variant and the gNA variant are associated together in a ribonuclear protein complex (RNP).

Embodiment 107. The gene editing pair of any one of embodiments 104-107, wherein the first gNA comprises a gNA variant of any one of embodiments 77-103, and a targeting sequence wherein the targeting sequence is complementary to the target nucleic acid.

Embodiment 108. The gene editing pair of any one of embodiments 104-107, wherein the CasX variant comprises a CasX variant of any one of embodiments 1-60.

Embodiment 109. The gene editing pair of any one of embodiments 104 to 108, comprising:
 a. a gNA variant of any one of embodiments 77-103, and
 b. a CasX variant of any one of embodiments 1-60.

Embodiment 110. The gene editing pair of embodiment 109, wherein the gene editing pair of the CasX variant and the gNA variant has one or more improved characteristics compared to a gene editing pair comprising a reference CasX protein of SEQ ID NO: 1, SEQ ID NO: 2, or SEQ ID NO: 3, and a reference guide nucleic acid of SEQ ID NOS: 4 or 5.

Embodiment 111. The gene editing pair of embodiment 110, wherein the one or more improved characteristics comprises improved CasX:gNA (RNP) complex stability, improved binding affinity between the CasX and gNA, improved kinetics of RNP complex formation, higher percentage of cleavage-competent RNP, improved RNP binding affinity to a target nucleic acid, ability to utilize an increased spectrum of PAM sequences, improved unwinding of the target nucleic acid, increased editing activity, improved editing efficiency, improved editing specificity, increased nuclease activity, increased target strand loading for double strand cleavage, decreased target strand loading for single strand nicking, decreased off-target cleavage, improved binding of the non-target strand of DNA, or improved resistance to nuclease activity.

Embodiment 112. The gene editing pair of embodiment 110 or embodiment 111, wherein the improved characteristic is enhanced editing efficiency of a target nucleic acid utilizing a non-canonical PAM sequence of ATC, GTC or CTC compared to a gene editing pair comprising a reference CasX protein of SEQ ID NO: 1, SEQ ID NO: 2, or SEQ ID NO: 3 or CasX variant 119 or 491, and a reference guide nucleic acid of SEQ ID NOS: 4 or 5 or a gNA variant of 174 (SEQ ID NO: 2238).

Embodiment 113. The gene editing pair of embodiment 110, wherein the at least one or more of the improved characteristics is at least about 1.1 to about 100-fold or more improved relative to a gene editing pair of the reference CasX protein and the reference guide nucleic acid.

Embodiment 114. The gene editing pair of embodiment 110, wherein one or more of the improved characteristics of the CasX variant is at least about 1.1, at least about 2, at least about 4, at least about 6, at least about 6, at least about 10, or at least about 100-fold or more improved relative to a gene editing pair of the reference CasX protein and the reference guide nucleic acid or a gNA variant of 174 (SEQ ID NO: 2238).

Embodiment 115. The gene editing pair of embodiment 110, wherein the improved characteristic comprises a 4- to 9-fold increase in editing efficiency compared to a reference editing pair of SEQ ID NO: 2 and SEQ ID NO: 5 or a gNA variant of 174 (SEQ ID NO: 2238), when assayed in an in vitro assay under comparable conditions.

Embodiment 116. The gene editing pair of any one of embodiments 104-115, wherein the RNP of the CasX variant and the gNA variant has a higher percentage of cleavage-competent RNP compared to an RNP of a reference CasX protein and a reference guide nucleic acid.

Embodiment 117. The gene editing pair of claim 116, wherein the RNP of the CasX variant and the gNA variant has at least a 2-fold, at least a 3-fold, at least a 4-fold, or at least a 5-fold higher percentage of cleavage-competent RNP compared to the RNP of the reference CasX protein and the reference guide nucleic acid.

Embodiment 118. The gene editing pair of any one of embodiments 104-117, wherein the RNP is capable of binding and cleaving a target nucleic acid.

Embodiment 119. The gene editing pair of any one of embodiments 104-118, wherein the RNP of the CasX variant and the gNA variant exhibit a specificity ratio within at least 10%, or at least 15%, or at least 20% compared to the reference editing pair of SEQ ID NO: 2 and SEQ ID NO: 5 or a gNA variant of 174 (SEQ ID NO: 2238), when assayed in an in vitro assay for on-target/off-target editing under comparable conditions.

Embodiment 120. The gene editing pair of any one of embodiments 104-111, wherein the RNP is capable of binding a target nucleic acid but is not capable of cleaving the target nucleic acid.

Embodiment 121. The gene editing pair of any one of embodiments 104-117, wherein the RNP is capable of binding a target nucleic acid and generating one or more single-stranded nicks in the target nucleic acid.

Embodiment 122. A composition comprising the gene editing pair of any one of embodiments 104-119, comprising:
  a. a second gene editing pair comprising the CasX variant of any one of embodiments 1-60; and
  b. a second gNA variant of any one of embodiments 61-103, wherein the second gNA variant has a targeting sequence complementary to a different or overlapping portion of the target nucleic acid compared to the targeting sequence of the first gNA.

Embodiment 123. A CasX variant comprising the amino acid sequence of any one of SEQ ID NOS: 89-101, 247-337, 411-592, or 760-982.

Embodiment 124. A gNA variant comprising the amino acid sequence of any one of SEQ ID NOS: 2101-2332.

Embodiment 125. The gene editing pair of any one of embodiments 104-121 for use as a medicament for the treatment of a subject having a disease.

Set IV

Embodiment 1. A guide RNA (gRNA) scaffold comprising a sequence having at least 60%, at least 70%, at least 80%, at least 90%, at least 95%, at least 98%, at least 99%, or 100% sequence identity to any one of the sequences selected from the group consisting of SEQ ID NOS: 2292, 2291, 2307, 2281-2290, 2293-2306, 2308-2332 and 23530-2398.

Embodiment 2. The gRNA scaffold of embodiment 1, comprising a sequence selected from the group consisting of SEQ ID NOS: 2292, 2291, 2307, 2281-2290, 2293-2306, 2308-2332 and 23530-2398.

Embodiment 3. The gRNA scaffold of embodiment 1, comprising a sequence having one or more modifications relative to SEQ ID NO: 2238, wherein the one or more modifications result in an improved characteristic.

Embodiment 4. The gRNA scaffold of embodiment 3, wherein the one or more modifications comprise one or more nucleotide substitutions, insertions, and/or deletions as set forth in Table 19.

Embodiment 5. The gRNA scaffold of embodiment 3 or embodiment 4, wherein the improved characteristic is one or more functional properties selected from the group consisting of increased editing activity, increased pseudoknot stem stability, increased triplex region stability, increased scaffold stem stability, extended stem stability, reduced off-target folding intermediates, and increased binding affinity to a Class 2, Type V CRISPR protein, optionally in an in vitro assay.

Embodiment 6. The gRNA scaffold of any one of embodiments 3 to 5, wherein the gRNA scaffold exhibits an improved enrichment score ($\log_2$) of at least about 2.0, at least about 2.5, at least about 3, or at least about 3.5 greater compared to the score of the gRNA scaffold of SEQ ID NO: 2238 in an in vitro assay.

Embodiment 7. The gRNA scaffold of embodiment 1, comprising a sequence having one or more modifications relative to SEQ ID NO: 2239, wherein the one or more modifications result in an improved characteristic.

Embodiment 8. The gRNA scaffold of embodiment 7, wherein the one or more modifications comprise one or more nucleotide substitutions, insertions, and/or deletions as set forth in Table 20.

Embodiment 9. The gRNA scaffold of embodiment 7 or embodiment 8, wherein the improved characteristic is one or more functional properties selected from the group consisting of increased editing activity, increased pseudoknot stem stability, increased triplex region stability, increased scaffold stem stability, extended stem stability, reduced off-target folding intermediates, and increased binding affinity to a Class 2, Type V CRISPR protein, optionally in an in vitro assay.

Embodiment 10. The gRNA scaffold of any one of embodiments 7 to 9, wherein the gRNA scaffold exhibits an improved enrichment score (log 2) of at least about 1.2, at least about 1.5, at least about 2.0, at least about 2.5, at least about 3, or at least about 3.5 greater compared to the score of the gRNA scaffold of SEQ ID NO: 2239 in an in vitro assay.

Embodiment 11. The gRNA scaffold of embodiment 1, comprising one or more modifications at positions relative to the sequence of SEQ ID NO: 2239 selected from the group consisting of C9, U11, C17, U24, A29, U54, G64, A88, and A95.

Embodiment 12. The gRNA scaffold of embodiment 11, comprising one or more modifications relative to the sequence of SEQ ID NO: 2239 selected from the group consisting of C9U, U11C, C17G, U24C, A29C, an insertion of G at position 54, an insertion of C at position 64, A88G, and A95G.

Embodiment 13. The gRNA scaffold of embodiment 12, comprising modifications relative to the sequence of SEQ ID NO: 2239 consisting of C9U, U11C, C17G, U24C, A29C, an insertion of G at position 54, an insertion of C at position 64, A88G, and A95G.

Embodiment 14. The gRNA scaffold of any one of embodiments 7 to 13, wherein the improved characteristic is selected from the group consisting of pseudoknot stem stability, triplex region stability, scaffold bubble stability, extended stem stability, and binding affinity to a Class 2, Type V CRISPR protein.

Embodiment 15. The gRNA scaffold of embodiment 14, wherein the insertion of C at position 64 and the A88G substitution relative to the sequence of SEQ ID NO: 2239 resolves an asymmetrical bulge element of the extended stem, enhancing the stability of the extended stem of the gRNA scaffold.

Embodiment 16. The gRNA scaffold of embodiment 14, wherein the substitutions of U11C, U24C, and A95G increase the stability of the triplex region of the gRNA scaffold.

Embodiment 17. The gRNA scaffold of embodiment 14, wherein the substitution of A29C increases the stability of the pseudoknot stem.

Embodiment 18. The gRNA scaffold of embodiment 1 or embodiment 2, wherein the gRNA scaffold comprises one or more heterologous RNA sequences in the extended stem.

Embodiment 19. The gRNA scaffold of embodiment 18, wherein the heterologous RNA is selected from the group consisting of a MS2 hairpin, Q13 hairpin, U1 hairpin II, Uvsx hairpin, and a PP7 stem loop, or sequence variants thereof.

Embodiment 20. The gRNA scaffold of embodiment 18 or embodiment 19, wherein the heterologous RNA sequence increases the stability of the gRNA.

Embodiment 21. The gRNA scaffold of embodiment 18 or embodiment 19, wherein the heterologous RNA is capable of binding a protein, a RNA, a DNA, or a small molecule.

Embodiment 22. The gRNA scaffold of any one of embodiments 18 to 21, wherein the gRNA scaffold comprises a Rev response element (RRE) or a portion thereof.

Embodiment 23. The gRNA scaffold of embodiment 22, wherein the RRE or portion thereof is selected from the group consisting of Stem IIB of the RRE having sequence UGGGCGCAGCGUCAAUGACGCUGACGGUACA (SEQ ID NO: 1280), Stem II-V of the RRE having sequence CAGGAAGCACUAUGGGCGCAGCGU-CAAUGACGCUGACGGUACAGGCCAGACAAU UAUUGUCUG-GUAUAGUGCAGCAGCAGAACAAUUUGCUGAGGGC-UAUUGAGGCGC AACAGCAUCUGUUGCAACU-CACAGUCUGGGGCAUCAAGCAGCUCCAGGCAA-GAA UCCUG (SEQ ID NO: 1282), Stem II of the RRE having sequence GCACUAUGGGCGCAGCGU-CAAUGACGCUGACGGUACAGGCCA-GACAAUUAUUGU CUGGUAUAGUGC (SEQ ID NO: 1281), Rev-binding element (RBE) of Stem IIB having sequence GCUGACGGUACAGGC (SEQ ID NO: 1284), and full-length RRE having sequence AGGAGCUUU-GUUCCUUGGGUUCUUGGGAGCAGCAGGAAGCAC-UAUGGGCGCAGC GUCAAUGACGCUGACGGUA-CAGGCCAGACAAUUAUUGUCUGGUAUAGUGCA-GCA GCAGAACAAUUUGCUGAGGGC-UAUUGAGGCGCAACAGCAUCUGUUGCAACUCAC AGUCUGGGGCAUCAAGCAG-CUCCAGGCAAGAAUCCUGGCUGUG-GAAAGAUACCU AAAGGAUCAACAGCUCCU (SEQ ID NO: 1283).

Embodiment 24. The gRNA of any one of embodiments 1 to 23, wherein the gRNA scaffold comprises one or more thymines (T).

Embodiment 25. A gRNA comprising the gRNA scaffold of any one of embodiments 1 to 24, and a targeting sequence at the 3' end of the gRNA scaffold that is complementary to a target nucleic acid sequence.

Embodiment 26. The gRNA of embodiment 25, wherein the targeting sequence has 10, 11, 12, 13, 14, 15, 16, 17, 18, 19, 20, 21, 22, 23, 24, 25, 26, 27, 28, 29, or 30 nucleotides.

Embodiment 27. The gRNA of embodiment 26, wherein the targeting sequence has 18, 19, or 20 nucleotides.

Embodiment 28. The gRNA of any one of embodiments 25 to 27, wherein the gRNA is capable of forming a ribonucleoprotein (RNP) complex with a Class 2, Type V CRISPR protein.

Embodiment 29. An engineered Class 2, Type V CRISPR protein comprising:
  a. a NTSB domain comprising a sequence of QPASK-KIDQNKLKPEMDEKGNLTTAG-FACSQCGQPLFVYKLEQVSEKGKAYTNYFGRC NVAEHEKLILLAQLKPEKDSDEAVTYSLGKFGQ (SEQ ID NO: 2335), or a sequence having at least 80% at least 90%, at least 95%, at least 96%, at least 97%, at least 98% or at least 99% identity thereto;
  b. a helical I-II domain comprising a sequence of RALDFYSIHVTKESTHPVKPLAQIAG-NRYASGPVGKALSDACMGTIASFLSKYQDIIIEH QKVVKGNQKRLESLRELAGKENLEY-PSVTLPPQPHTKEGVDAYNEVIARVRMWVNLN LWQKLKLSRDDAKPLLRLKGFPSF (SEQ ID NO: 2336), or a sequence having at least 80%, at least 90%, at least 95%, at least 96%, at least 97%, at least 98% or at least 99% identity thereto;
  c. a helical II domain comprising a sequence of PLVER-QANEVDWWDMVCNVKKLINEKKEDGKVFWQN-LAGYKRQEALRPYLSSEEDR KKGKK-FARYQLGDLLLHLEKKHGEDWGKVYDEAWER-IDKKVEGLSKHIKLEEERRSE DAQSKAALTDWL-RAKASFVIEGLKEADKDEFCR-CELKLQKWYGDLRGKPFAIEAE (SEQ ID NO: 2351), or a sequence having at least 80%, at least 90%, at least 95%, at least 96%, at least 97%, at least 98% or at least 99% identity thereto; and d. a RuvC-I domain comprising a sequence of SSNIKPMNLIGVDRGENIPAVI-ALTDPEGCPLSRFKDSLGNPTHILRIGE-SYKEKQRTIQAK KEVEQRRAG-GYSRKYASKAKNLADDMVRNTARDLLYYAVT-QDAMLIFENLSRGFGRQ GKRTFMAER-QYTRMEDWLTAKLAYEGLPSKTYLSKT-LAQYTSKTC (SEQ ID NO: 2352), or a sequence having at least 80%, at least 90%, at least 95%, at least 96%, at least 97%, at least 98% or at least 99% identity thereto.

Embodiment 30. The Class 2, Type V CRISPR protein of embodiment 29, wherein the CRISPR protein comprises an OBD-I domain comprising a sequence of QEIKRINKIRRRLVKDSNTKKAGKTGPMKTLL-VRVMTPDLRERLENLRKKPENIPQ (SEQ ID NO: 2342), or a sequence having at least 80%, at least 90%, at least 95%, at least 96%, at least 97%, at least 98%, or at least 99% identity thereto.

Embodiment 31. The Class 2, Type V CRISPR protein of embodiment 29 or embodiment 30, wherein the CRISPR protein comprises an OBD-II domain comprising a sequence of NSILDISGFSKQYNCAFIWQKDGVKKLNLYLI-INYFKGGKLRFKKIKPEAFEANRFYTVIN KKSGEIVP-MEVNFNFDDPNLIILPLAFGKRQGREFIWNDLLS-LETGSLKLANGRVIEKTL YNRRTRQDEPALFVALTFERREVLD (SEQ ID NO: 2347), or a sequence having at least 80%, at least 90%, at least 95%, at least 96%, at least 97%, at least 98%, or at least 99% identity thereto.

Embodiment 32. The Class 2, Type V CRISPR protein of any one of embodiments 29 to 31, wherein the CRISPR protein comprises a helical I-I domain comprising a sequence of PISNTSRANLNKLLTDYTEMKKAILHVY-WEEFQKDPVGLMSRVA (SEQ ID NO: 2343), or a sequence having at least 80%, at least 90%, at least 95%, at least 96%, at least 97%, at least 98%, or at least 99% identity thereto.

Embodiment 33. The Class 2, Type V CRISPR protein of any one of embodiments 29 to 32, wherein the CRISPR protein comprises a TSL domain comprising a sequence of SNCGFTITSADYDRVLEKLKKTATGWMT-TINGKELKVEGQITYYNRYKRQNVVKDLSV ELDRL-SEESVNNDISSWTKGRS-GEALSLLKKRFSHRPVQEKFVCLNCGFETH (SEQ ID NO: 2349), or a sequence having at least 80%, at least 90%, at least 95%, at least 96%, at least 97%, at least 98%, or at least 99% identity thereto.

Embodiment 34. The Class 2, Type V CRISPR protein of any one of embodiments 29 to 33, wherein the CRISPR protein comprises a RuvC-II domain comprising a sequence of ADEQAALNIARSWLFLR-SQEYKKYQTNKTTGNTDKRAFVETWQSFYRKKLK-EVWKPAV (SEQ ID NO: 2350), or a sequence having at least 80%, at least 90%, at least 95%, at least 96%, at least 97%, at least 98%, or at least 99% identity thereto.

Embodiment 35. The Class 2, Type V CRISPR protein of embodiment 34, comprising the sequence of SEQ ID NO: 416, or a sequence having at least 80%, at least 90%, at least 95%, at least 96%, at least 97%, at least 98% or at least 99% identity thereto.

Embodiment 36. The Class 2, Type V CRISPR protein of any one of embodiments 29 to 35, wherein the Class 2, Type V CRISPR protein comprises at least one modification in one or more domains.

Embodiment 37. The Class 2, Type V CRISPR protein of embodiment 36, wherein the at least one modification comprises:

a. at least one amino acid substitution in a domain;
b. at least one amino acid deletion in a domain;
c. at least one amino acid insertion in a domain; or
d. any combination of (a)-(c).

Embodiment 38. The Class 2, Type V CRISPR protein of embodiment 36 or embodiment 37, comprising a modification at one or more amino acid positions in the NTSB domain relative to SEQ ID NO: 2335 selected from the group consisting of P2, S4, Q9, E15, G20, G33, L41, Y51, F55, L68, A70, E75, K88, and G90.

Embodiment 39. The Class 2, Type V CRISPR protein of embodiment 38, wherein the one or more modifications at one or more amino acid positions in the NTSB domain are selected from the group consisting of an insertion of G at position 2, an insertion of I at position 4, an insertion of L at position 4, Q9P, E155, G20D, a deletion of S at position 30, G33T, L41A, Y51T, F55V, L68D, L68E, L68K, A70Y, A70S, E75A, E75D, E75P, K88Q, and G90Q relative to SEQ ID NO: 2335.

Embodiment 40. The Class 2, Type V CRISPR protein of any one of embodiments 36 to 39, comprising a modification at one or more amino acid positions in the helical I-II domain relative to SEQ ID NO: 2336 selected from the group consisting of I24, A25, Y29 G32, G44, S48, S51, Q54, I56, V63, S73, L74, K97, V100, M112, L116, G137, F138, and S140.

Embodiment 41. The Class 2, Type V CRISPR protein of embodiment 40, wherein the one or more modifications at one or more amino acid positions in the helical I-II domain are selected from the group consisting of an insertion of T at position 24, an insertion of C at position 25, Y29F, G32Y, G32N, G32H, G32S, G32T, G32A, G32V, a deletion of G at position 32, G32S, G32T, G44L, G44H, S48H, S48T, S51T, Q54H, I56T, V63T, S73H, L74Y, K97G, K97S, K97D, K97E, V100L, M112T, M112W, M112R, M112K, L116K, G137R, G137K, G137N, an insertion of Q at position 138, and S140Q relative to SEQ ID NO: 2336.

Embodiment 42. The Class 2, Type V CRISPR protein of any one of embodiments 36 to 41, comprising a modification at one or more amino acid positions in the helical II domain relative to SEQ ID NO: 2351 selected from the group consisting of L2, V3, E4, R5, Q6, A7, E9, V10, D11, W12, W13, D14, M15, V16, C17, N18, V19, K20, L22, I23, E25, K26, K31, Q35, L37, A38, K41, R42, Q43, E44, L46, K57, Y65, G68, L70, L71, L72, E75, G79, D81, W82, K84, V85, Y86, D87, I93, K95, K96, E98, L100, K102, I104, K105, E109, R110, D114, K118, A120, L121, W124, L125, R126, A127, A129, I133, E134, G135, L136, E138, D140, K141, D142, E143, F144, C145, C147, E148, L149, K150, L151, Q152, K153, L158, E166, and A167.

Embodiment 43. The Class 2, Type V CRISPR protein of embodiment 42, wherein the one or more modifications at one or more amino acid positions in the helical II domain are selected from the group consisting of an insertion of A at position 2, an insertion of H at position 2, a deletion of L at position 2 and a deletion of V at position 3, V3E, V3Q, V3F, a deletion of V at position 3, an insertion of D at position 3, V3P, E4P, a deletion of E at position 4, E4D, E4L, E4R, R5N, Q6V, an insertion of Q at position 6, an insertion of G at position 7, an insertion of H at position 9, an insertion of A at position 9, VD10, an insertion of T1 at position 0, a deletion of V at position 10, an insertion of F at position 10, an insertion of D at position 11, a deletion of D at position 11, D11S, a deletion of W at position 12, W12T, W12H, an insertion of P at position 12, an insertion of Q at position 13, an insertion of G at position 12, an insertion of R at position 13, W13P, W13D, an insertion of D at position 13, W13L, an insertion of P at position 14, an insertion of D at position 14, a deletion of D at position 14 and a deletion of M at position 15, a deletion of M at position 15, an insertion of T at position 16, an insertion of P at position 17, N18I, V19N, V19H, K20D, L22D, I23S, E25C, E25P, an insertion of G at position 25, K26T, K27E, K31L, K31Y, Q35D, Q35P, an insertion of S at position 37, a deletion of L at position 37 and a deletion of A at position 38, K41L, an insertion of R at position 42, a deletion of Q at position 43 and a deletion of E at position 44, L46N, K57Q, Y65T, G68M, L70V, L71C, L72D, L72N, L72W, L72Y, E75F, E75L, E75Y, G79P, an insertion of E at position 79, an insertion of T at position 81, an insertion of R at position 81, an insertion of W at position 81, an insertion of Y at position 81, an insertion of W at position 82, an insertion of Y at position 82, W82G, W82R, K84D, K84H, K84P, K84T, V85L, V85A, an insertion of L at position 85, Y86C, D87G, D87M, D87P, I93C, K95T, K96R, E98G, L100A, K102H, I104T, I104S, I104Q, K105D, an insertion of K at position 109, E109L, R110D, a deletion of R at position 110, D114E, an insertion of D at position 114, K118P, A120R, L121T, W124L, L125C, R126D, A127E, A127L, A129T, A129K, I133E, an insertion of C at position 133, an insertion of S at position 134, an insertion of G at position 134, an insertion of R at position 135, G135P, L136K, L136D, L136S, L136H, a deletion of E at position 138, D140R, an insertion of D at position 140, an insertion of P at position 141, an insertion of D at position 142, a deletion of E at position 143+a deletion of F at position 144, an insertion of Q at position 143, F144K, a deletion of F at position 144, a deletion of F at position 144 and a deletion of C at position 145, C145R, an insertion of G at position 145, C145K, C147D, an insertion of V at position 148, E148D, an insertion of H at position 149, L149R, K150R, L151H, Q152C, K153P, L158S, E166L, and an insertion of F at position 167 relative to SEQ ID NO: 2351.

Embodiment 44. The Class 2, Type V CRISPR protein of any one of embodiments 36 to 43, comprising a modification at one or more amino acid positions in the RuvC-I domain relative to SEQ ID NO: 2352 selected from the group consisting of I4, K5, P6, M7, N8, L9, V12, G49, K63, K80, N83, R90, M125, and L146.

Embodiment 45. The Class 2, Type V CRISPR protein of embodiment 44, wherein the one or more modifications at one or more amino acid positions in the RuvC-I domain are selected from the group consisting of an insertion of I at position 4, an insertion of S at position 5, an insertion of T at position 6, an insertion of N at position 6, an insertion of R at position 7, an insertion of K at position 7, an insertion of H at position 8, an insertion of S at position 8, V12L, G49W, G49R, S51R, S51K, K62S, K62T, K62E, V65A, K80E, N83G, R90H, R90G, M125S, M125A, L137Y, an insertion of P at position 137, a deletion of L at position 141, L141R, L141D, an insertion of Q at position 142, an insertion of R at position 143, an insertion of N at position 143, E144N, an insertion of P at position 146, L146F, P147A, K149Q, T150V, an insertion of R at position 152, an insertion of H153, T155Q, an insertion of H at position 155, an insertion of R at position 155, an insertion of L at position 156, a deletion of L at position 156, an insertion of W at position 156, an insertion of A at position 157, an insertion of F at position 157, A157S, Q158K, a deletion of Y at position 159, T160Y, T160F, an insertion of I at position 161, S161P, T163P, an insertion of N at position 163, C164K, and C164M relative to SEQ ID NO: 2351.

Embodiment 46. The Class 2, Type V CRISPR protein of any one of embodiments 36 to 45, comprising a modification at one or more amino acid positions in the OBD-I domain relative to SEQ ID NO: 2342 selected from the group consisting of I3, K4, R5, I6, N7, K8, K15, D16, N18, P27, M28, V33, R34, M36, R41, L47, R48, E52, P55, and Q56.

Embodiment 47. The Class 2, Type V CRISPR protein of embodiment 46, wherein the one or more modifications at one or more amino acid positions in the OBD-I domain are selected from the group consisting of an insertion of G at position 3, I3G, I3E, an insertion of G at position 4, K4G, K4P, K4S, K4W, K4W, R5P, an insertion of P at position 5, an insertion of G at position 5, RSS, an insertion of S at position 5, R5A, R5P, R5G, R5L, I6A, I6L, an insertion of G at position 6, N7Q, N7L, N7S, K8G, K15F, D16W, an insertion of F at position 16, an insertion of F18, an insertion of P at position 27, M28P, M28H, V33T, R34P, M36Y, R41P, L47P, an insertion of P at position 48, E52P, an insertion of P at position 55, a deletion of P at position 55 and a deletion of Q at position 56, Q56S, Q56P, an insertion of D at position 56, an insertion of T at position 56, and Q56P relative to SEQ ID NO: 2342.

Embodiment 48. The Class 2, Type V CRISPR protein of any one of embodiments 36 to 47, comprising a modification at one or more amino acid positions in the OBD-II domain relative to SEQ ID NO: 2347 selected from the group consisting of S2, I3, L4, K11, V24, K37, R42, A53, T58, K63, M70, I82, Q92, G93, K110, L121, R124, R141, E143, V144, and L145.

Embodiment 49. The Class 2, Type V CRISPR protein of embodiment 48, wherein the one or more modifications at one or more amino acid positions in the OBD-II domain are selected from the group consisting of a deletion of S at position 2, I3R, I3K, a deletion of I at position 3 and a deletion of L4, a deletion of L at position 4, K11T, an insertion of P at position 24, K37G, R42E, an insertion of S at position 53, an insertion of R at position 58, a deletion of K at position 63, M70T, I82T, Q92I, Q92F, Q92V, Q92A, an insertion of A at position 93, K110Q, R115Q, L121T, an insertion of A at position 124, an insertion of R at position 141, an insertion of D at position 143, an insertion of A at position 143, an insertion of W at position 144, and an insertion of A at position 145 relative to SEQ ID NO: 2342.

Embodiment 50. The Class 2, Type V CRISPR protein of any one of embodiments 36 to 49, comprising a modification at one or more amino acid positions in the TSL domain relative to SEQ ID NO: 2349 selected from the group consisting of S1, N2, C3, G4, F5, I7, K18, V58, S67, T76, G78, S80, G81, E82, S85, V96, and E98.

Embodiment 51. The Class 2, Type V CRISPR protein of embodiment 50, wherein the one or more modifications at one or more amino acid positions in the OBD-II domain are selected from the group consisting of an insertion of M at position 1, a deletion of N at position 2, an insertion of V at position 2, C3S, an insertion of G at position 4, an insertion of W at position 4, F5P, an insertion of W at position 7, K18G, V58D, an insertion of A at position 67, T76E, T76D, T76N, G78D, a deletion of S at position 80, a deletion of G at position 81, an insertion of E at position 82, an insertion of N at position 82, S85I, V96C, V96T, and E98D relative to SEQ ID NO: 2349.

Embodiment 52. The Class 2, Type V CRISPR protein of any one of embodiments 29 to 51, exhibiting an improved characteristic relative to SEQ ID NO: 2, wherein the improved characteristic comprises increased binding affinity to a gRNA, increased binding affinity to the target nucleic acid, improved ability to utilize a greater spectrum of PAM sequences in the editing of the target nucleic acid, improved unwinding of the target nucleic acid, increased editing activity, improved editing efficiency, improved editing specificity for cleavage of the target nucleic acid, decreased off-target editing or cleavage of the target nucleic acid, increased percentage of a eukaryotic genome that can be edited, increased activity of the nuclease, increased target strand loading for double strand cleavage, decreased target strand loading for single strand nicking, increased binding of the non-target strand of DNA, improved protein stability, increased protein:gRNA (RNP) complex stability, and improved fusion characteristics.

Embodiment 53. The Class 2, Type V CRISPR protein of embodiment 52, wherein the improved characteristic comprises increased cleavage activity at a target nucleic sequence comprising an TTC, ATC, GTC, or CTC PAM sequence.

Embodiment 54. The Class 2, Type V CRISPR protein of embodiment 53, wherein the improved characteristic comprises increased cleavage activity at a target nucleic acid sequence comprising an ATC or CTC PAM sequence relative to cleavage activity of the sequence of SEQ ID NO: 416.

Embodiment 55. The Class 2, Type V CRISPR protein of embodiment 54, wherein the improved cleavage activity is an enrichment score ($\log_2$) of at least about 1.5, at least about 2.0, at least about 2.5, at least about 3, at least about 3.5, at least about 4, at least about 4.5, at least about 5, at least about 6, at least about 7, at least about 8 or more greater compared to score of the sequence of SEQ ID NO: 416 in an in vitro assay.

Embodiment 56. The Class 2, Type V CRISPR protein of embodiment 54, wherein the improved characteristic comprises increased cleavage activity at a target nucleic acid sequence comprising an CTC PAM sequence relative to the sequence of SEQ ID NO: 416.

Embodiment 57. The Class 2, Type V CRISPR protein of embodiment 56, wherein the improved cleavage activity is an enrichment score ($\log_2$) of at least about 2, at least about 2.5, at least about 3, at least about 3.5, at least about 4, at least about 4.5, at least about 5, or at least about 6 or more greater compared to the score of the sequence of SEQ ID NO: 416 in an in vitro assay.

Embodiment 58. The Class 2, Type V CRISPR protein of embodiment 53, wherein the improved characteristic comprises increased cleavage activity at a target nucleic acid sequence comprising an TTC PAM sequence relative to the sequence of SEQ ID NO: 416.

Embodiment 59. The Class 2, Type V CRISPR protein of embodiment 58, wherein the improved cleavage activity is an enrichment score of at least about 1.5, at least about 2.0, at least about 2.5, at least about 3, at least about 3.5, at least about 4, at least about 4.5, at least about 5, or at least about 6 log 2 or more greater compared to the sequence of SEQ ID NO: 416 in an in vitro assay.

Embodiment 60. The Class 2, Type V CRISPR protein of embodiment 52, wherein the improved characteristic comprises increased specificity for cleavage of the target nucleic acid sequence relative to the sequence of SEQ ID NO: 416.

Embodiment 61. The Class 2, Type V CRISPR protein of embodiment 60, wherein the increased specificity is an enrichment score of at least about 2.0, at least about 2.5, at least about 3, at least about 3.5, at least about 4, at least about 4.5, at least about 5, or at least about 6 log 2 or more greater compared to the sequence of SEQ ID NO: 416 in an in vitro assay.

Embodiment 62. The Class 2, Type V CRISPR protein of embodiment 52, wherein the improved characteristic comprises decreased off-target cleavage of the target nucleic acid sequence.

Embodiment 63. The Class 2, Type V CRISPR protein of any one of embodiments 29 to 62, wherein the Class 2, Type V CRISPR protein has a sequence selected from the group consisting of the sequences of SEQ ID NOS: 415-592 and 1147-1231, as set forth in Table 3, or a sequence having at least about 50%, at least about 60%, at least about 70%, at least about 80%, at least about 90%, or at least about 95%, or at least about 96%, or at least about 97%, or at least about 98%, or at least about 99%, sequence identity thereto.

Embodiment 64. The Class 2, Type V CRISPR protein of any one of embodiments 29 to 62, comprising a sequence selected from the group consisting of SEQ ID NOS: 415-592 and 1147-1231, as set forth in Table 3.

Embodiment 65. The Class 2, Type V CRISPR protein of any one of embodiments 29 to 64, comprising one or more nuclear localization signals (NLS).

Embodiment 66. The Class 2, Type V CRISPR protein of embodiment 65, wherein the one or more NLS are selected from the group of sequences consisting of PKKKRKV (SEQ ID NO: 352), KRPAATKKAGQAKKKK (SEQ ID NO: 353), PAAKRVKLD (SEQ ID NO: 354), RQRRNELKRSP (SEQ ID NO: 355), NQSSNFGPMKGGNFG-GRSSGPYGGGGQYFAKPRNQGGY (SEQ ID NO: 356), RMRIZFKNKGKDTAELRRRRVEVSVELRKAKKD-EQILKRRNV (SEQ ID NO: 357), VSRKRPRP (SEQ ID NO: 358), PPKKARED (SEQ ID NO: (359), PQPKKKPL (SEQ ID NO: 360), SALIKKKKKMAP (SEQ ID NO: 361), DRLRR (SEQ ID NO: 362), PKQKKRK (SEQ ID NO: 363), RKLKKKIKKL (SEQ ID NO: 364), REKKKFLKRR (SEQ ID NO: 365), KRKGDEVDGVDEVAKKKSKK (SEQ ID NO: 366), RKCLQAGMNLEARKTKK (SEQ ID NO: 367), PRPRKIPR (SEQ ID NO: 368), PPRKKRTVV (SEQ ID NO: 369), NLSKKKKRKREK (SEQ ID NO: 370), RRPSRPFRKP (SEQ ID NO: 371), KRPRSPSS (SEQ ID NO: 372), KRGINDRNFWRGENERKTR (SEQ ID NO: 373), PRPPKMARYDN (SEQ ID NO: 374), KRSFSKAF (SEQ ID NO: 375), KLKIKRPVK (SEQ ID NO: 376), PKKKRKVPPPPAAKRVKLD (SEQ ID NO: 377), PKTRRRPRRSQRKRPPT (SEQ ID NO: 378), SRRR-KANPTKLSENAKKLAKEVEN (SEQ ID NO: 379), KTRRRPRRSQRKRPPT (SEQ ID NO: 380), RRKKRR-PRRKKRR (SEQ ID NO: 381), PKKKSRKPKKKSRK (SEQ ID NO: 382), HKKKHPDASVNFSEFSK (SEQ ID NO: 383), QRPGPYDRPQRPGPYDRP (SEQ ID NO: 384), LSPSLSPLLSPSLSPL (SEQ ID NO: 385), RGKGGKGLGKGGAKRHRK (SEQ ID NO: 386), PKR-GRGRPKRGRGR (SEQ ID NO: 387), PKKKRKVPPPPKKKRKV (SEQ ID NO: 389), PAKRARRGYKC (SEQ ID NO: 63), KLGPRKATGRW (SEQ ID NO: 64), PRRKREE (SEQ ID NO: 65), PYR-GRKE (SEQ ID NO: 66), PLRKRPRR (SEQ ID NO: 67), PLRKRPRRGSPLRKRPRR (SEQ ID NO:68), PAAKRVKLDGGKRTADGSEFESPKKKRKV (SEQ ID NO:69), PAAKRVKLDGGKRTADGSEF-ESPKKKRKVGIHGVPAA (SEQ ID NO:70), PAAKRVKLDGGKRTADGSEFESPKKKRK-VAEAAAKEAAAKEAAAKA (SEQ ID NO:71), PAAKRVKLDGGKRTADGSEFESPKKKRKVPG (SEQ ID NO:72), KRKGSPERGERKRHW (SEQ ID NO:73), KRTADSQHSTPPKTKRKVEFEPKKKRKV (SEQ ID NO:74), and PKKKRKVGGSKRTADSQH-STPPKTKRKVEFEPKKKRKV (SEQ ID NO:75), and, optionally, wherein the one or more NLS are linked to the Class 2, Type V CRISPR protein or to an adjacent NLS with a linker peptide wherein the linker peptide is selected from the group consisting of SR, RS, (G)n (SEQ ID NO: 1023), (GS)n (SEQ ID NO: 1024), (GSGGS)n (SEQ ID NO: 399), (GGSGGS)n (SEQ ID NO: 400), (GGGS)n (SEQ ID NO: 401), GGSG (SEQ ID NO: 402), GGSGG (SEQ ID NO: 403), GSGSG (SEQ ID NO: 404), GSGGG (SEQ ID NO: 405), GGGSG (SEQ ID NO: 406), GSSSG (SEQ ID NO: 407), GPGP (SEQ ID NO: 408), GGP, PPP, PPAPPA (SEQ ID NO: 409), PPPG (SEQ ID NO: 24), PPPGPPP (SEQ ID NO: 410), PPP(GGGS)n (SEQ ID NO: 25), (GGGS)nPPP (SEQ ID NO: 26), AEAAAKEAAAKEAAAKA (SEQ ID NO: 1025), and TPPKTKRKVEFE (SEQ ID NO: 27), wherein n is 1 to 5.

Embodiment 67. The Class 2, Type V CRISPR protein of embodiment 65 or embodiment 66, wherein the one or more NLS are positioned at or near the C-terminus of the protein.

Embodiment 68. The Class 2, Type V CRISPR protein of embodiment 65 or embodiment 66, wherein the one or more NLS are positioned at or near at the N-terminus of the protein.

Embodiment 69. The Class 2, Type V CRISPR protein of embodiment 65 or embodiment 66, comprising at least two NLS, wherein the at least two NLS are positioned at or near the N-terminus and at or near the C-terminus of the protein.

Embodiment 70. The Class 2, Type V CRISPR protein of any one of embodiments 29 to 69, wherein the Class 2, Type V CRISPR protein is capable of forming a ribonuclear protein complex (RNP) with a gRNA.

Embodiment 71. The Class 2, Type V CRISPR protein of embodiment 70, wherein the RNP exhibits at least one or more improved characteristics as compared to a an RNP of a reference protein of any one of SEQ ID NOS: 1-3 and a gRNA of SEQ ID NO: 4 or SEQ ID NO: 5.

Embodiment 72. The Class 2, Type V CRISPR protein of embodiment 71, wherein the improved characteristic is selected from the group consisting of increased binding affinity to a guide nucleic acid (gRNA); increased binding affinity to a target nucleic acid; improved ability to utilize a greater spectrum of one or more PAM sequences, including ATC, CTC, GTC, or TTC, in the editing of target nucleic acid; increased unwinding of the target nucleic acid; increased editing activity; increased editing efficiency; increased editing specificity of the target nucleic acid; increased nuclease activity; increased target strand loading for double strand cleavage; decreased target strand loading for single strand nicking; decreased off-target cleavage of the target nucleic acid; increased binding of non-target nucleic acid strand; and increased protein:gRNA complex (RNP) stability.

Embodiment 73. The Class 2, Type V CRISPR protein of embodiment 71 or embodiment 72, wherein the improved characteristic of the RNP is at least about 1.1 to about 100,000-fold increased relative to the RNP of the reference protein of SEQ ID NO: 1, SEQ ID NO: 2, or SEQ ID NO: 3 and the gRNA of SEQ ID NO: 4 or SEQ ID NO: 5.

Embodiment 74. The Class 2, Type V CRISPR protein of embodiment 71 or embodiment 72, wherein the improved characteristic of the RNP is at least about 10-fold, at least about 100-fold, at least about 1,000-fold, or at least about 10,000-fold increased relative to the RNP of the reference protein of SEQ ID NO: 1, SEQ ID NO: 2, or SEQ ID NO: 3 and the gRNA of SEQ ID NOS: 4 or 5.

Embodiment 75. The Class 2, Type V CRISPR protein of any one of embodiments 71 to 74, wherein the improved characteristic of the RNP comprises a 1.1 to 100-fold improvement in editing efficiency compared to the RNP of the reference protein of SEQ ID NO: 2 and the gRNA comprising of SEQ ID NOS: 4 or 5.

Embodiment 76. A gene editing pair comprising a gRNA and a Class 2, Type V CRISPR protein, the pair comprising:
a. a gRNA of any one of embodiments 25 to 28; and
b. a Class 2, Type V CRISPR protein of any one of embodiments 29 to 75.

Embodiment 77. The gene editing pair of embodiment 76, wherein the gRNA and the Class 2, Type V CRISPR protein are capable of forming a ribonuclear protein complex (RNP).

Embodiment 78. The gene editing pair of embodiment 76 or embodiment 77, wherein the gRNA and the Class 2, Type V CRISPR protein are associated together as a ribonuclear protein complex (RNP).

Embodiment 79. The gene editing pair of embodiment 77 or embodiment 78, wherein an RNP of the Class 2, Type V CRISPR protein and the gRNA exhibit at least one or more improved characteristics as compared to an RNP of a reference protein of SEQ ID NO: 1, SEQ ID NO: 2, or SEQ ID NO: 3 and a gRNA comprising a sequence of SEQ ID NO: 4 or SEQ ID NO: 5.

Embodiment 80. The gene editing pair of embodiment 79, wherein the improved characteristic is selected from one or more of the group consisting of increased binding affinity of the Class 2, Type V CRISPR protein to the gRNA; increased binding affinity to a target nucleic acid; increased ability to utilize a greater spectrum of one or more PAM sequences, including ATC, CTC, GTC, or TTC, in the editing of target nucleic acid; increased unwinding of the target nucleic acid; increased editing activity; increased editing efficiency; increased editing specificity of the target nucleic acid; increased nuclease activity; increased target strand loading for double strand cleavage; decreased target strand loading for single strand nicking; decreased off-target cleavage of the target nucleic acid; increased binding of non-target nucleic acid strand; increased protein:gRNA complex (RNP) stability; and increased fusion characteristics.

Embodiment 81. The gene editing pair of embodiment 79 or embodiment 80, wherein the improved characteristic of the RNP of the Class 2, Type V CRISPR protein and the gRNA is at least about 1.1 to about 100-fold or more increased relative to the RNP of the reference protein of SEQ ID NO: 1, SEQ ID NO: 2, or SEQ ID NO: 3 and the gRNA comprising a sequence of SEQ ID NO: 4 or SEQ ID NO: 5 in a comparable in vitro assay system.

Embodiment 82. The gene editing pair of embodiment 79 or embodiment 80, wherein the improved characteristic of the Class 2, Type V CRISPR protein is at least about 1.1, at least about 2, at least about 10, at least about 100-fold or more increased relative to the reference protein of SEQ ID NO: 1, SEQ ID NO: 2, or SEQ ID NO: 3 and the gRNA comprising a sequence of SEQ ID NO: 4 or SEQ ID NO: 5 in a comparable in vitro assay system.

Embodiment 83. The gene editing pair of any one of embodiments 77 to 82, wherein the RNP comprising the Class 2, Type V CRISPR protein and the gRNA exhibits greater editing efficiency and/or binding of a target nucleic acid sequence in the target nucleic acid when any one of the PAM sequences TTC, ATC, GTC, or CTC is located 1 nucleotide 5' to the non-target strand of the protospacer having identity with the targeting sequence of the gRNA in a cellular assay system compared to the editing efficiency and/or binding of an RNP comprising a reference protein of SEQ ID NO: 1, SEQ ID NO: 2, or SEQ ID NO: 3 and a reference gRNA in a comparable assay system.

Embodiment 84. The gene editing pair of embodiment 83, wherein the PAM sequence is TTC.

Embodiment 85. The gene editing pair of embodiment 83, wherein the PAM sequence is ATC.

Embodiment 86. The gene editing pair of embodiment 83, wherein the PAM sequence is CTC.

Embodiment 87. The gene editing pair of embodiment 83, wherein the PAM sequence is GTC.

Embodiment 88. The gene editing pair of any one of embodiments 83 to 87, wherein the RNP comprising the Class 2, Type V CRISPR and the gRNA exhibits increased binding affinity for the one or more PAM sequences that is at least 1.5-fold, at least 2-fold, at least 4-fold, at least 10-fold, at least 20-fold, at least 30-fold, or at least 40-fold greater compared to the binding affinity of an RNP of any one of the reference proteins of SEQ ID NOS:1-3 and the gRNA of SEQ ID NO: 4 or SEQ ID NO: 5, when assessed in a comparable in vitro assay system.

Embodiment 89. The gene editing pair of any one of embodiments 77 to 88, wherein the RNP of the Class 2, Type V CRISPR protein and the gRNA exhibits increased editing efficiency that is at least 1.5-fold, at least 2-fold, at least 4-fold, at least 10-fold, at least 20-fold, at least 30-fold, or at least 40-fold greater compared to the editing efficiency of an RNP of any one of the reference proteins of SEQ ID NOS:1-3 and the gRNA of SEQ ID NO: 4 or SEQ ID NO: 5, when assessed in a comparable in vitro assay system.

Embodiment 90. The gene editing pair of any one of embodiments 77 to 89, wherein the Class 2, Type V CRISPR and the gRNA are able to form RNP having at least about a 5%, at least about a 10%, at least about a 15%, or at least about a 20% higher percentage of cleavage-competent conformation compared to an RNP of any one of the reference proteins of SEQ ID NOS: 1-3 and the gRNA of SEQ ID NO: 4 or SEQ ID NO: 5, when assessed in a comparable in vitro assay system.

Embodiment 91. The gene editing pair of any one of embodiments 77 to 90, wherein the RNP comprising the Class 2, Type V CRISPR and the gRNA exhibit a cleavage rate for the target nucleic acid in a timed in vitro assay that is at least about 5-fold, at least about 10-fold, or at least about 20-fold higher compared to an RNP of any one of the reference proteins of SEQ ID NOS: 1-3 and the gRNA of SEQ ID NO: 4 or SEQ ID NO: 5, when assessed in a comparable in vitro assay system.

Embodiment 92. The gene editing pair of any one of embodiments 77 to 91, wherein the RNP comprising the Class 2, Type V CRISPR and the gRNA exhibit higher percent editing of the target nucleic acid in a timed in vitro assay that is at least about 5-fold, at least about 10-fold, at least about 20-fold, or at least about 100-fold higher compared to an RNP of any one of the reference proteins of SEQ ID NOS: 1-3 and the gRNA of SEQ ID NO: 4 or SEQ ID NO:5, when assessed in a comparable in vitro assay system.

Embodiment 93. A catalytically-dead Class 2, Type V CRISPR protein, comprising a sequence selected from the group consisting of SEQ NOS: 44-62 and 1232-1235, as set forth in Table 7, or a sequence having at least 60%, at least 70%, at least 80%, at least 90%, at least 95%, at least 98%, at least 99% thereto.

Embodiment 94. A catalytically-dead Class 2, Type V CRISPR protein, comprising a sequence selected from the group consisting of SEQ NOS: 44-62 and 1232-1235, as set forth in Table 7.

Embodiment 95. The Class 2, Type V CRISPR protein of embodiment 93 or embodiment 94, wherein and RNP of the catalytically-dead Class 2, Type V CRISPR protein and a gRNA of any one of embodiments 25 to 28 retain the ability to bind target nucleic acid.

Embodiment 96. A nucleic acid comprising a sequence that encodes the gRNA scaffold of any one of embodiments 1 to 24, or the gRNA of any one of embodiments 25 to 28.

Embodiment 97. A nucleic acid comprising a sequence that encodes the Class 2, Type V CRISPR protein of any one of embodiments 29 to 75.

Embodiment 98. The nucleic acid of embodiment 97, wherein the sequence that encodes the Class 2, Type V CRISPR protein is codon optimized for expression in a eukaryotic cell.

Embodiment 99. A vector comprising the gRNA of any one of embodiments 25 to 28, the Class 2, Type V CRISPR protein of any one of embodiments 29 to 75, or the nucleic acid of any one of embodiments 96 to 98.

Embodiment 100. The vector of embodiment 99, wherein the vector comprises a promoter.

Embodiment 101. The vector of embodiment 99 or embodiment 100, wherein the vector is selected from the group consisting of a retroviral vector, a lentiviral vector, an adenoviral vector, an adeno-associated viral (AAV) vector, a herpes simplex virus (HSV) vector, a CasX delivery particle (XDP), a plasmid, a minicircle, a nanoplasmid, a DNA vector, and an RNA vector.

Embodiment 102. The vector of embodiment 101, wherein the vector is an AAV vector.

Embodiment 103. The vector of embodiment 102, wherein the AAV vector is selected from AAV1, AAV2, AAV3, AAV4, AAV5, AAV6, AAV7, AAV8, AAV9, AAV10, AAV11, AAV12, AAV-Rh74, or AAVRh10.

Embodiment 104. The vector of embodiment 101, wherein the vector is a retroviral vector.

Embodiment 105. The vector of embodiment 101, wherein the vector is a XDP comprising one or more components of a gag polyprotein.

Embodiment 106. The vector of embodiment 105, wherein the one or more components of the gag polyprotein are selected from the group consisting of matrix protein (MA), a nucleocapsid protein (NC), a capsid protein (CA), a p1 peptide, a p6 peptide, a P2A peptide, a P2B peptide, a P10 peptide, a p12 peptide, a PP21/24 peptide, a P12/P3/P8 peptide, a P20 peptide, and a protease cleavage site.

Embodiment 107. The vector of embodiment 105 or embodiment 106, wherein the Class 2, Type V CRISPR protein and the gRNA are associated together in an RNP.

Embodiment 108. The vector of any one of embodiments 105 to 107, comprising a glycoprotein tropism factor.

Embodiment 109. The vector of embodiment 108, wherein the glycoprotein tropism factor has binding affinity for a cell surface marker of a target cell and facilitates entry of the XDP into the target cell.

Embodiment 110. The vector of any one of embodiments 99 to 109, comprising the donor template.

Embodiment 111. A host cell comprising the vector of any one of embodiments 99 to 110.

Embodiment 112. The host cell of embodiment 111, wherein the host cell is selected from the group consisting of Baby Hamster Kidney fibroblast (BHK) cells, human embryonic kidney 293 (HEK293) cells, human embryonic kidney 293T (HEK293T) cells, NS0 cells, SP2/0 cells, YO myeloma cells, P3X63 mouse myeloma cells, PER cells, PER.C6 cells, hybridoma cells, NIH3T3 cells, CV-1 (simian) in Origin with SV40 genetic material (COS) cells, HeLa, Chinese hamster ovary (CHO) cells, or yeast cells.

Embodiment 113. A method of modifying a target nucleic acid in a cell, comprising contacting the target nucleic acid of the cell with: i) the gene editing pair of any one of embodiments 76 to 92; ii) the gene editing pair of any one of embodiments 76 to 92 together with a donor template; iii) one or more nucleic acids encoding the gene editing pair of (i) or (ii); iv) a vector comprising the nucleic acid of (iii); v) an XDP comprising the gene editing pair of (i) or (ii); or vi) combinations of two or more of (i) to (v), wherein the contacting of the target nucleic acid modifies the target nucleic acid.

Embodiment 114. The method of embodiment 113, comprising contacting the target with a plurality of gene editing pairs comprising a first and a second, or a plurality of gRNAs comprising targeting sequences complementary to different or overlapping regions of the target nucleic acid.

Embodiment 115. The method of embodiment 113, comprising contacting the target with a plurality of nucleic acids encoding gene editing pairs comprising a first and a second, or a plurality of gRNAs comprising targeting sequences complementary to different or overlapping regions of the target nucleic acid.

Embodiment 116. The method of embodiment 113, comprising contacting the target with a plurality of XDP comprising gene editing pairs comprising a first and a second, or a plurality of gRNAs comprising targeting sequences complementary to different or overlapping regions of the target nucleic acid.

Embodiment 117. The method of any one of embodiment 113, wherein the contacting comprises binding the target nucleic acid with the gene editing pair and introducing one or more single-stranded breaks in the target nucleic acid, wherein the modifying comprises introducing a mutation, an insertion, or a deletion in the target nucleic acid.

Embodiment 118. The method of any one of embodiments 113 to 116 wherein the contacting comprises binding the target nucleic acid and introducing one or more double-stranded breaks in the target nucleic acid, wherein the modifying comprises introducing a mutation, an insertion, or a deletion in the target nucleic acid.

Embodiment 119. The method of any one of embodiments 113 to 118, comprising contacting the target nucleic acid with a nucleotide sequence of a donor template nucleic acid wherein the donor template comprises a nucleotide sequence having homology to the target nucleic acid.

Embodiment 120. The method of embodiment 119, wherein the donor template comprises homologous arms on the 5' and 3' ends of the donor template.

Embodiment 121. The method of embodiment 119 or embodiment 120, wherein the donor template is inserted in the target nucleic acid at the break site by homology-directed repair.

Embodiment 122. The method of embodiment 121, wherein the donor template is inserted in the target nucleic acid at the break site by non-homologous end joining (NHEJ) or micro-homology end joining (MMEJ).

Embodiment 123. The method of any one of embodiments 113 to 122, wherein the modifying of the cell occurs in vitro.

Embodiment 124. The method of any one of embodiments 113 to 122, wherein modifying of the cell occurs in vivo.

Embodiment 125. The method of any one of embodiments 113 to 124, wherein the cell is a eukaryotic cell.

Embodiment 126. The method of embodiment 125, wherein the eukaryotic cell is selected from the group consisting of a rodent cell, a mouse cell, a rat cell, a primate cell, and a non-human primate cell.

Embodiment 127. The method of embodiment 125, wherein the eukaryotic cell is a human cell.

Embodiment 128. The method of any one of embodiments 113 to 127, wherein the cell is selected from the group consisting of an embryonic stem cell, an induced pluripotent stem cell, a germ cell, a fibroblast, an oligodendrocyte, a glial cell, a hematopoietic stem cell, a neuron progenitor cell, a neuron, a muscle cell, a bone cell, a hepatocyte, a pancreatic cell, a retinal cell, a cancer cell, a T-cell, a B-cell, an NK cell, a fetal cardiomyocyte, a myofibroblast, a mesenchymal stem cell, an autotransplanted expanded cardiomyocyte, an adipocyte, a totipotent cell, a pluripotent cell, a blood stem cell, a myoblast, an adult stem cell, a bone marrow cell, a mesenchymal cell, a parenchymal cell, an epithelial cell, an endothelial cell, a mesothelial cell, a fibroblast cell, an osteoblast cell, a chondrocyte cell, an exogenous cell, an endogenous cell, a stem cell, a hematopoietic stem cell, a bone-marrow derived progenitor cell, a myocardial cell, a skeletal cell, a fetal cell, an undifferentiated cell, a multi-potent progenitor cell, a unipotent progenitor cell, a monocyte, a cardiac myoblast, a skeletal myoblast, a macrophage, a capillary endothelial cell, a xenogenic cell, an allogenic cell, an autologous cell, and a post-natal stem cell.

Embodiment 129. The method of any one of embodiments 124 to 128, wherein the cell is in a subject.

Embodiment 130. The method of embodiment 129, wherein the modifying occurs in the cells of the subject having a mutation in an allele of a gene wherein the mutation causes a disease or disorder in the subject.

Embodiment 131. The method of embodiment 130, wherein the modifying changes the mutation to a wild type allele of the gene or results in the expression of a functional gene product.

Embodiment 132. The method of embodiment 130, wherein the modifying knocks down or knocks out the allele of the gene causing the disease or disorder in the subject.

Embodiment 133. The method of any one of embodiments 129 to 132, wherein the cell is autologous with respect to the subject.

Embodiment 134. The method of any one of embodiments 129 to 132, wherein the cell is allogeneic autologous with respect to the subject.

Embodiment 135. The method of any one of embodiments 113 to 134, wherein the vector is an Adeno-Associated Viral (AAV) vector.

Embodiment 136. The method of embodiment 135, wherein the AAV is AAV1, AAV2, AAV3, AAV4, AAV5, AAV6, AAV7, AAV8, AAV9, AAV10, AAV-Rh74, or AAVRh10.

Embodiment 137. The method of embodiment 113, wherein the vector is a lentiviral vector.

Embodiment 138. The method of any one of embodiments 113 to 137, wherein the vector is administered to a subject in need using a therapeutically effective dose.

Embodiment 139. The method of embodiment 138, wherein the subject is selected from the group consisting of mouse, rat, pig, and non-human primate.

Embodiment 140. The method of embodiment 138, wherein the subject is a human.

Embodiment 141. The method of any one of embodiments 138 to 140, wherein the vector is administered to the subject at a dose of at least about $1 \times 10^5$ vector genomes/kg (vg/kg), at least about $1 \times 10^6$ vg/kg, at least about $1 \times 10^7$ vg/kg, at least about $1 \times 10^8$ vg/kg, at least about $1 \times 10^9$ vg/kg, at least about $1 \times 10^{10}$ vg/kg, at least about $1 \times 10^{11}$ vg/kg, at least about $1\times10^{12}$ vg/kg, at least about $1\times10^{13}$ vg/kg, at least about $1\times10^{14}$ vg/kg, at least about $1\times10^{15}$ vg/kg, or at least about $1\times10^{16}$ vg/kg.

Embodiment 142. The method of any one of embodiments 138 to 140, wherein the vector is administered to the subject at a dose of at least about $1\times10^5$ vg/kg to about $1\times10^{16}$ vg/kg, at least about $1\times10^6$ vg/kg to about $1\times10^{15}$ vg/kg, or at least about $1\times10^7$ vg/kg to about $1\times10^{14}$ vg/kg.

Embodiment 143. The method of embodiment 113, wherein the vector is an XDP.

Embodiment 144. The method of embodiment 143, wherein the XDP is administered to the subject in need using a therapeutically effective dose.

Embodiment 145. The method of embodiment 144, wherein the XDP is administered to the subject at a dose of at least about $1\times10^5$ particles/kg, at least about $1\times10^6$ particles/kg, at least about $1\times10^7$ particles/kg at least about $1\times10^8$ particles/kg, at least about $1\times10^9$ particles/kg, at least about $1\times10^{10}$ particles/kg, at least about $1\times10^{11}$ particles/kg, at least about $1\times10^{12}$ particles/kg, at least about $1\times10^{13}$ particles/kg, at least about $1\times10^{14}$ particles/kg, at least about $1\times10^{15}$ particles/kg, at least about $1\times10^{16}$ particles/kg.

Embodiment 146. The method of embodiment 143, wherein the XDP is administered to the subject at a dose of at least about $1\times10^5$ particles/kg to about $1\times10^{16}$ particles/kg, or at least about $1\times10^6$ particles/kg to about $1\times10^{15}$ particles/kg, or at least about $1\times10^7$ particles/kg to about $1\times10^{14}$ particles/kg.

Embodiment 147. The method of any one of embodiments 138 to 146, wherein the vector is administered by a route of administration selected from the group consisting of intraparenchymal, intravenous, intra-arterial, intracerebroventricular, intracisternal, intrathecal, intracranial, and intraperitoneal routes wherein the administering method is injection, transfusion, or implantation.

Embodiment 148. The method of any one of embodiments 141 to 147, wherein the vector is administered to the subject according to a treatment regimen comprising one or more consecutive doses using a therapeutically effective dose of the vector.

Embodiment 149. The method of embodiment 148, wherein the therapeutically effective dose is administered to the subject as two or more doses over a period of at least two weeks, or at least one month, or at least two months, or at least three months, or at least four months, or at least five months, or at least six months, or once a year, or every 2 or 3 years.

Embodiment 150. A cell comprising a target nucleic acid modified by the gene editing pair of any one of embodiments 76 to 92.

Embodiment 151. A cell edited by the method of any one of embodiments 113 to 149.

Embodiment 152. The cell of embodiment 150 or 151, wherein the cell is a prokaryotic cell.

Embodiment 153. The cell of embodiment 150 or 151, wherein the cell is a eukaryotic cell.

Embodiment 154. The cell of embodiment 153, wherein the eukaryotic cell is selected from the group consisting of a rodent cell, a mouse cell, a rat cell, a primate cell, and a non-human primate cell.

Embodiment 155. The cell of embodiment 153, wherein the eukaryotic cell is a human cell.

Embodiment 156. A composition, comprising the Class 2, Type V CRISPR protein of any one of embodiments 29 to 75.

Embodiment 157. The composition of embodiment 156, comprising the gRNA of any one of embodiments 25 to 28.

Embodiment 158. The composition of embodiment 157, wherein the protein and the gRNA are associated together in a ribonuclear protein complex (RNP).

Embodiment 159. The composition of any one of embodiments 156 to 158, comprising a donor template nucleic acid wherein the donor template comprises a nucleotide sequence having homology to a target nucleic acid.

Embodiment 160. The composition of any one of embodiments 156 to 159, comprising a buffer, a nuclease inhibitor, a protease inhibitor, a liposome, a therapeutic agent, a label, a label visualization reagent, or any combination of the foregoing.

Embodiment 161. A composition, comprising a gRNA scaffold of any one of embodiments 1 to 24, or a gRNA of any one of embodiments 25 to 28.

Embodiment 162. The composition of embodiment 161, comprising the Class 2, Type V CRISPR protein of any one of embodiments 29 to 75.

Embodiment 163. The composition of embodiment 162, wherein the Class 2, Type V CRISPR protein and the gRNA are associated together in a ribonuclear protein complex (RNP).

Embodiment 164. The composition of any one of embodiments 161 to 163, comprising a donor template nucleic acid wherein the donor template comprises a nucleotide sequence having homology to a target nucleic acid.

Embodiment 165. The composition of any one of embodiments 161 to 164, comprising a buffer, a nuclease inhibitor, a protease inhibitor, a liposome, a therapeutic agent, a label, a label visualization reagent, or any combination of the foregoing.

Embodiment 166. A composition, comprising the gene editing pair of any one of embodiments 76 to 92.

Embodiment 167. The composition of embodiment 166, comprising a donor template nucleic acid wherein the donor template comprises a nucleotide sequence having homology to a target nucleic acid.

Embodiment 168. The composition of embodiment 166 or embodiment 167, comprising a buffer, a nuclease inhibitor, a protease inhibitor, a liposome, a therapeutic agent, a label, a label visualization reagent, or any combination of the foregoing.

Embodiment 169. A kit, comprising the Class 2, Type V CRISPR protein of any one of embodiments 29 to 75 and a container.

Embodiment 170. The kit of embodiment 169, comprising a gRNA scaffold of any one of embodiments 1 to 24, or a gRNA of any one of embodiments 25 to 28.

Embodiment 171. The kit of embodiment 169 or embodiment 170, comprising a donor template nucleic acid wherein the donor template comprises a nucleotide sequence having homology to a target nucleic acid sequence of a target nucleic acid.

Embodiment 172. The kit of any one of embodiments 169 to 171, comprising a buffer, a nuclease inhibitor, a protease inhibitor, a liposome, a therapeutic agent, a label, a label visualization reagent, or any combination of the foregoing.

Embodiment 173. A kit, comprising a gRNA scaffold of any one of embodiments 1 to 24, or a gRNA of any one of embodiments 25 to 28.

Embodiment 174. The kit of embodiment 173, comprising the Class 2, Type V CRISPR protein of any one of embodiments 29 to 75.

Embodiment 175. The kit of embodiment 173 or embodiment 174, comprising a donor template nucleic acid wherein the donor template comprises a nucleotide sequence having homology to a target nucleic acid sequence of a target nucleic acid.

Embodiment 176. The kit of any one of embodiments 173 to 175, comprising a buffer, a nuclease inhibitor, a protease inhibitor, a liposome, a therapeutic agent, a label, a label visualization reagent, or any combination of the foregoing.

Embodiment 177. A kit, comprising the gene editing pair of any one of embodiments 76 to 92.

Embodiment 178. The kit of embodiment 177, comprising a donor template nucleic acid wherein the donor template comprises a nucleotide sequence having homology to a target nucleic acid.

Embodiment 179. The kit of embodiment 177 or embodiment 178, comprising a buffer, a nuclease inhibitor, a protease inhibitor, a liposome, a therapeutic agent, a label, a label visualization reagent, or any combination of the foregoing.

Embodiment 180. An engineered Class 2, Type V CRISPR protein comprising any one of the sequences listed in Table 3.

Embodiment 181. A gRNA comprising any one of the gRNA scaffold variant sequences listed in Table 2.

Embodiment 182. The gRNA of embodiment 181, wherein one or more uracils (U) of the gRNA scaffold variants of the Table 2 sequences are replaced with thymines (T).

Embodiment 183. The gRNA of embodiment 182, comprising a targeting sequence of at least 10 to 30 nucleotides complementary to a target nucleic acid.

Embodiment 184. The gRNA of embodiment 183, wherein the targeting sequence has 20 nucleotides.

Embodiment 185. The gRNA of embodiment 183, wherein the targeting sequence has 19 nucleotides.

Embodiment 186. The gRNA of embodiment 183, wherein the targeting sequence has 18 nucleotides.

Embodiment 187. The gRNA of embodiment 183, wherein the targeting sequence has 17 nucleotides.

Embodiment 188. The gRNA of embodiment 183, wherein the targeting sequence has 16 nucleotides.

Embodiment 189. The gRNA of embodiment 183, wherein the targeting sequence has 15 nucleotides.

Embodiment 190. A method of treating a disease in a subject in need thereof, comprising administering to the subject a therapeutically effective amount of a composition comprising: (a) an engineered class 2, type V CRISPR protein of any one of embodiments 29 to 75 and 180 and (b) a gRNA of any one of embodiments 25 to 28 and 181 to 189.

Embodiment 191. A composition comprising: (a) an engineered class 2, type V CRISPR protein of any one of embodiments 29 to 75 and 180 and (b) a gRNA of any one of embodiments 25 to 28 and 181 to 189, for use as a medicament for the treatment of a subject having a disease.

The following Examples are merely illustrative and are not meant to limit any aspects of the present disclosure in any way.

EXAMPLES

Example 1: Generating CasX Variant Constructs

In order to generate the CasX 488 construct (sequences in Table 9), the codon-optimized CasX 119 construct (based on the CasX Stx2 construct, encoding Planctomycetes CasX SEQ ID NO: 2, with amino acid substitutions and deletions) was cloned into a destination plasmid (pStX) using standard cloning methods. In order to generate the CasX 491 construct (sequences in Table 9), the codon-optimized CasX 484 construct (based on the CasX Stx2 construct, encoding Planctomycetes CasX SEQ ID NO: 2, with substitutions and deletions of certain amino acids, with fused NLS, and linked guide and non-targeting sequences) was cloned into a destination plasmid (pStX) using standard cloning methods. Construct CasX 1 (CasX SEQ ID NO: 1) was cloned into a destination vector using standard cloning methods. To build CasX 488, the CasX 119 construct DNA was PCR amplified in two reactions using Q5 DNA polymerase according to the manufacturer's protocol, using universal appropriate primers. To build CasX 491, the codon optimized CasX 484 construct DNA was PCR amplified in two reactions using Q5 DNA polymerase according to the manufacturer's protocol, using appropriate primers. The CasX 1 construct was PCR amplified in two reactions using Q5 DNA polymerase according to the manufacturer's protocol, universal appropriate primers. Each of the PCR products were purified by gel extraction from a 1% agarose gel (Gold Bio Cat #A-201-500) using Zymoclean™ Gel DNA Recovery Kit according to the manufacturer's protocol. The corresponding fragments were then pieced together using Gibson® assembly (New England BioLabs Cat #E2621S) following the manufacturer's protocol. Assembled products in pStx1 were transformed into chemically-competent Turbo Competent *E. coli* bacterial cells, plated on LB-Agar plates containing kanamycin. Individual colonies were picked and mini-prepped using Qiagen spin Miniprep Kit following the manufacturer's protocol. The resultant plasmids were sequenced using Sanger sequencing to ensure correct assembly. The correct clones were then subcloned into the mammalian expression vector pStx34 using restriction enzyme cloning. The pStx34 backbone and the CasX 488 and 491 clones in pStx1 were digested with XbaI and BamHI respectively. The digested backbone and respective insert fragments were purified by gel extraction from a 1% agarose gel (Gold Bio Cat #A-201-500) using Zymoclean™ Gel DNA Recovery Kit according to the manufacturer's protocol. The clean backbone and insert were then ligated together using T4 Ligase (New England Biolabs Cat #M0202L) according to the manufacturer's protocol. The ligated products were transformed into chemically-competent Turbo Competent *E. coli* bacterial cells, plated on LB-Agar plates containing carbenicillin. Individual colonies were picked and mini-prepped using Qiagen spin Miniprep Kit following the manufacturer's protocol. The resultant plasmids were sequenced using Sanger sequencing to ensure correct assembly.

To build CasX 515 (sequences in Table 9), the CasX 491 construct DNA was PCR amplified in two reactions using Q5 DNA polymerase according to the manufacturer's protocol, using appropriate primers. To build CasX 527 (sequences in Table 9), the CasX 491 construct DNA was PCR amplified in two reactions using Q5 DNA polymerase according to the manufacturer's protocol, using appropriate primers. The PCR products were purified by gel extraction from a 1% agarose gel using Zymoclean™ Gel DNA Recovery Kit according to the manufacturer's protocol. The pStX backbone was digested using XbaI and SpeI in order to remove the 2931 base pair fragment of DNA between the two sites in plasmid pStx56. The digested backbone fragment was purified by gel extraction from a 1% agarose gel using Zymoclean™ Gel DNA Recovery Kit according to the manufacturer's protocol. The insert and backbone fragments were then pieced together using Gibson® assembly (New England BioLabs Cat #E2621S) following the manufacturer's protocol. Assembled products in the pStx56 were transformed into chemically-competent Turbo Competent *E. coli* bacterial cells, plated on LB-Agar plates containing kanamycin. Individual colonies were picked and miniprepped using Qiagen spin Miniprep Kit following the manufacturer's protocol. The resultant plasmids were sequenced using Sanger sequencing to ensure correct assembly. pStX34 includes an EF-1c promoter for the protein as well as a selection marker for both puromycin and carbenicillin. pStX56 includes an EF-1a promoter for the protein as well as a selection marker for both puromycin and kanamycin Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase and an appropriate restriction enzyme for the plasmid. Golden Gate products were transformed into chemically or electro-competent cells such as NEB Turbo competent *E. coli* (NEB Cat #C2984I), plated on LB-Agar plates containing the appropriate antibiotic. Individual colonies were picked and miniprepped using Qiaprep® spin Miniprep Kit and following the manufacturer's protocol. The resultant plasmids were sequenced using Sanger sequencing to ensure correct ligation.

To build CasX 535-537 (sequences in Table 9), the CasX 515 construct DNA was PCR amplified in two reactions for each construct using Q5 DNA polymerase according to the manufacturer's protocol. For CasX 535, appropriate primers were used for the amplification. For CasX 536 appropriate primers were used. For CasX 537, appropriate primers were used. The PCR products were purified by gel extraction from a 1% agarose gel using Zymoclean™ Gel DNA Recovery Kit according to the manufacturer's protocol. The pStX backbone was digested using XbaI and SpeI in order to remove the 2931 base pair fragment of DNA between the two sites in plasmid pStx56. The digested backbone fragment was purified by gel extraction from a 1% agarose gel using Zymoclean™ Gel DNA Recovery Kit according to the manufacturer's protocol. The insert and backbone fragments were then pieced together using Gibson® assembly following the manufacturer's protocol. Assembled products in pStx56 were transformed into chemically-competent Turbo Competent *E. coli* bacterial cells, plated on LB-Agar plates containing kanamycin. Individual colonies were picked and miniprepped using Qiagen spin Miniprep Kit following the manufacturer's protocol. The resultant plasmids were sequenced using Sanger sequencing to ensure correct assembly. pStX34 includes an EF-1a promoter for the protein as well as a selection marker for both puromycin and carbenicillin. pStX56 includes an EF-1a promoter for the protein as well as a selection marker for both puromycin and kanamycin. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase and an appropriate restriction enzyme for the plasmid. Golden Gate products were transformed into chemically or electro-competent cells such as NEB Turbo competent *E. coli*, plated on LB-Agar plates containing the appropriate antibiotic. Individual colonies were picked and miniprepped using Qiaprep® spin Miniprep Kit and following the manufacturer's protocol. The resultant plasmids were sequenced using Sanger sequencing to ensure correct ligation.

All subsequent CasX variants, such as CasX 544 and CasX 660-664, 668, 670, 672, 676, and 677 were cloned using the same methodology as described above using Gibson® assembly with mutation-specific internal primers and universal forward and reverse primers (the differences between them were the mutation specific primers designed as well as which CasX base construct was used). SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods.

The expression and recovery of the CasX constructs was performed using standard methodologies and are summarized as follows:

Purification:

Frozen samples were thawed overnight at 4° C. with magnetic stirring. The viscosity of the resulting lysate was reduced by sonication and lysis was completed by homogenization in two passes at 20k PSI using a NanoDeBEE (BEE International). Lysate was clarified by centrifugation at 50,000×g, 4° C., for 30 minutes and the supernatant was collected. The clarified supernatant was applied to a Heparin 6 Fast Flow column (Cytiva) using an AKTA Pure FPLC (Cytiva). The column was washed with 5 CV of Heparin Buffer A (50 mM HEPES-NaOH, 250 mM NaCl, 5 mM MgCl2, 0.5 mM TCEP, 10% glycerol, pH 8), then with 3 CV of Heparin Buffer B (Buffer A with the NaCl concentration adjusted to 500 mM). Protein was eluted with 1.75 CV of Heparin Buffer C (Buffer A with the NaCl concentration adjusted to 1 M). The eluate was applied to a StrepTactin HP column (Cytiva) using the FPLC. The column was washed with 10 CV of Strep Buffer (50 mM HEPES-NaOH, 500 mM NaCl, 5 mM MgCl2, 0.5 mM TCEP, 10% glycerol, pH 8). Protein was eluted from the column using 1.65 CV of Strep Buffer with 2.5 mM Desthiobiotin added. CasX-containing fractions were pooled, concentrated at 4° C. using a 50 kDa cut-off spin concentrator (Amicon), and purified by size exclusion chromatography on a Superdex 200 pg column (Cytiva). The column was equilibrated with SEC Buffer (25 mM sodium phosphate, 300 mM NaCl, 1 mM TCEP, 10% glycerol, pH 7.25) and operated by FPLC. CasX-containing fractions that eluted at the appropriate molecular weight were pooled, concentrated at 4° C. using a 50 kDa cut-off spin concentrator, aliquoted, and snap-frozen in liquid nitrogen before being stored at −80° C.

CasX variant 488: The average yield was 2.7 mg of purified CasX protein per liter of culture at 98.8% purity, as evaluated by colloidal Coomassie staining.

CasX Variant 491: The average yield was 12.4 mg of purified CasX protein per liter of culture at 99.4% purity, as evaluated by colloidal Coomassie staining.

CasX variant 515: The average yield was 7.8 mg of purified CasX protein per liter of culture at 90% purity, as evaluated by colloidal Coomassie staining.

CasX variant 526: The average yield was 13.79 mg per liter of culture, at 93% purity. Purity was evaluated by colloidal Coomassie staining.

CasX variant 668: The average yield was 3.32 mg per liter of culture, at 93% purity. Purity was evaluated by colloidal Coomassie staining.

CasX variant 672: The average yield was 6.50 mg per liter of culture, at 88% purity. Purity was evaluated by colloidal Coomassie staining.

CasX variant 676: The average yield was 5.05 mg per liter of culture, at 92% purity. Purity was evaluated by colloidal Coomassie staining.

CasX variant 677: The average yield was 2.93 mg per liter of culture, at 81% purity. Purity was evaluated by colloidal Coomassie staining.

TABLE 9

CasX variant DNA and amino acid sequences

| Construct | DNA SEQ ID NO | Amino Acid SEQ ID NO |
|---|---|---|
| CasX 488 | 1027 | 1045 |
| CasX 491 | 1028 | 1046 |
| CasX 515 | 1029 | 1047 |
| CasX 527 | 1030 | 1048 |
| CasX 535 | 1031 | 1049 |
| CasX 536 | 1032 | 1050 |
| CasX 537 | 1033 | 1051 |
| CasX 583 | 1034 | 1052 |
| CasX 660 | 1035 | 1053 |
| CasX 661 | 1036 | 1054 |
| CasX 662 | 1037 | 1055 |
| CasX 663 | 1038 | 1056 |
| CasX 664 | 1039 | 1057 |
| CasX 668 | 1040 | 1058 |
| CasX 670 | 1041 | 1059 |
| CasX 672 | 1042 | 1060 |
| CasX 676 | 1043 | 1061 |
| CasX 677 | 1044 | 1062 |

Example 2: Generation of RNA Guides

For the generation of RNA single guides and targeting sequences, templates for in vitro transcription were generated by performing PCR with Q5 polymerase, template primers for each backbone, and amplification primers with the T7 promoter and the targeting sequence. The DNA primer sequences for the T7 promoter, guide and targeting sequence for guides and targeting sequences are presented in Table 10, below. The sg1, sg2, sg32, sg64, sg174, and sg235 guides correspond to SEQ ID NOS: 4, 5, 2104, 2106, 2238, and 2292, respectively, with the exception that sg2, sg32, and sg64 were modified with an additional 5' G to increase transcription efficiency (compare sequences in Table 10 to Table 2). The 7.37 targeting sequence targets beta2-microglobulin (B2M). Following PCR amplification, templates were cleaned and isolated by phenol-chloroform-isoamyl alcohol extraction followed by ethanol precipitation.

In vitro transcriptions were carried out in buffer containing 50 mM Tris pH 8.0, 30 mM MgCl2, 0.01% Triton™ X-100, 2 mM spermidine, 20 mM DTT, 5 mM NTPs, 0.5 µM template, and 100 µg/mL T7 RNA polymerase. Reactions were incubated at 37° C. overnight. 20 units of DNase I (Promega #M6101)) were added per 1 mL of transcription volume and incubated for one hour. RNA products were purified via denaturing PAGE, ethanol precipitated, and resuspended in 1× phosphate buffered saline. To fold the sgRNAs, samples were heated to 70° C. for 5 mM and then cooled to room temperature. The reactions were supplemented to 1 mM final MgCl$_2$ concentration, heated to 50° C. for 5 mM and then cooled to room temperature. Final RNA guide products were stored at −80° C.

TABLE 10

DNA primer sequences for the T7 promoter, guide and targeting sequence for guides

| Primer | | SEQ ID NO |
|---|---|---|
| T7 promoter primer | GAAATTAATACGACTCACTATA (used for all) | 169 |
| | RNA product | |
| sg2 backbone fwd | GGUACUGGCGCUUUUAUCUCAUUACUUUGAGAGCCAUCACC | 1063 |
| sg2 backbone rev | AGCGACUAUGUCGUAUGGGUAAAGCGCUUAUUUAUCGGAGA | |
| sg2.7.37 spacer primer | GAAAUCCGAUAAAUAAGAAGCAUCAAAGGGCCGAGAUGUCU CGCUCCG | |
| sg32 backbone fwd | GGUACUGGCGCUUUUAUCUCAUUACUUUGAGAGCCAUCACC | 1064 |
| sg32 backbone rev | AGCGACUAUGUCGUAUGGGUAAAGCGCCCUCUUCGGAGGGA | |
| sg32.7.37 spacer primer | AGCAUCAAAGGGCCGAGAUGUCUCG | |
| sg64 backbone fwd | GGUACUGGCGCCUUUAUCUCAUUACUUUGAGAGCCAUCACC | 1065 |
| sg64 backbone rev | AGCGACUAUGUCGUAUGGGUAAAGCGCUUACGGACUUCGGU | |
| sg64.7.37 spacer primer | CCGUAAGAAGCAUCAAAGGGCCGAGAUGUCUCGCUCCG | |
| sg174 backbone fwd | ACUGGCGCUUUUAUCUgAUUACUUUGAGAGCCAUCACCAGC | 1066 |
| sg174 backbone rev | GACUAUGUCGUAgUGGGUAAAGCUCCCUCUUCGGAGGGAGC | |
| sg174.7.37 spacer primer | AUCAAAGGGCCGAGAUGUCUCGCUCCG | |
| sg235 backbone fwd | ACUGGCGCUUCUAUCUGAUUACUCUGAGCGCCAUCACCAGC | 1067 |
| sg235 backbone rev | GACUAUGUCGUAGUGGGUAAAGCCGCUUACGGACUUCGGUC | |
| sg235.7.37 spacer primer | CGUAAGAGGCAUCAGAG | |

Example 3: Assessing Binding Affinity to the Guide RNA

Purified wild-type and improved CasX will be incubated with synthetic single-guide RNA containing a 3' Cy7.5 moiety in low-salt buffer containing magnesium chloride as well as heparin to prevent non-specific binding and aggregation. The sgRNA will be maintained at a concentration of 10 pM, while the protein will be titrated from 1 pM to 100 µM in separate binding reactions. After allowing the reaction to come to equilibrium, the samples will be run through a vacuum manifold filter-binding assay with a nitrocellulose membrane and a positively charged nylon membrane, which bind protein and nucleic acid, respectively. The membranes will be imaged to identify guide RNA, and the fraction of bound vs unbound RNA will be determined by the amount of fluorescence on the nitrocellulose vs nylon membrane for each protein concentration to calculate the dissociation constant of the protein-sgRNA complex. The experiment will also be carried out with improved variants of the sgRNA to determine if these mutations also affect the affinity of the guide for the wild-type and mutant proteins. We will also perform electromobility shift assays to qualitatively compare to the filter-binding assay and confirm that soluble binding, rather than aggregation, is the primary contributor to protein-RNA association.

Example 4: Assessing Binding Affinity to the Target DNA

Purified wild-type and improved CasX will be complexed with single-guide RNA bearing a targeting sequence complementary to the target nucleic acid. The RNP complex will be incubated with double-stranded target DNA containing a PAM and the appropriate target nucleic acid sequence with a 5' Cy7.5 label on the target strand in low-salt buffer containing magnesium chloride as well as heparin to prevent non-specific binding and aggregation. The target DNA will be maintained at a concentration of 1 nM, while the RNP will be titrated from 1 pM to 100 µM in separate binding reactions. After allowing the reaction to come to equilibrium, the samples will be run on a native 5% polyacrylamide gel to separate bound and unbound target DNA. The gel will be imaged to identify mobility shifts of the target DNA, and the fraction of bound vs unbound DNA will be calculated for each protein concentration to determine the dissociation constant of the RNP-target DNA ternary complex.

Example 5: Assessing Differential PAM Recognition In Vitro

1. Comparison of Reference and CasX Variants

In vitro cleavage assays were performed using CasX2, CasX119, and CasX438 complexed with sg174.7.37, essentially as describe in Example 8. Fluorescently labeled dsDNA targets with a 7.37 spacer and either a TTC, CTC, GTC, or ATC PAM were used (sequences are in Table 11). Time points were taken at 0.25, 0.5, 1, 2, 5, 10, 30, and 60 minutes. Gels were imaged with an Cytiva Typhoon and quantified using the IQTL 8.2 software. Apparent first-order rate constants for non-target strand cleavage ($k_{cleave}$) were determined for each CasX:sgRNA complex on each target. Rate constants for targets with non-TTC PAM were compared to the TTC PAM target to determine whether the relative preference for each PAM was altered in a given protein variant.

For all variants, the TTC target supported the highest cleavage rate, followed by the ATC, then the CTC, and finally the GTC target (FIGS. 10A-D, Table 12). For each combination of CasX variant and NTC PAM, the cleavage rate $k_{cleave}$ is shown. For all non-NTC PAMs, the relative cleavage rate as compared to the TTC rate for that variant is shown in parentheses. All non-TTC PAMs exhibited substantially decreased cleavage rates (>10-fold for all). The ratio between the cleavage rate of a given non-TTC PAM and the TTC PAM for a specific variant remained generally consistent across all variants. The CTC target supported cleavage 3.5-4.3% as fast as the TTC target; the GTC target supported cleavage 1.0-1.4% as fast; and the ATC target supported cleavage 6.5-8.3% as fast. The exception is for 491, where the kinetics of cleavage at TTC PAMs are too fast to allow accurate measurement, which artificially decreases the apparent difference between TTC and non-TTC PAMs. Comparing the relative rates of 491 on GTC, CTC, and ATC PAMs, which fall within the measurable range, results in ratios comparable to those for other variants when comparing across non-TTC PAMs, consistent with the rates increasing in tandem. Overall, differences between the variants are not substantial enough to suggest that the relative preference for the various NTC PAMs have been altered. However, the higher basal cleavage rates of the variants allow targets with ATC or CTC PAMs to be cleaved nearly completely within 10 minutes, and the apparent $k_{cleaves}$ are comparable to or greater than the $k_{cleave}$ of CasX2 on a TTC PAM (Table 12). This increased cleavage rate may cross the threshold necessary for effective genome editing in a human cell, explaining the apparent increase in PAM flexibility for these variants.

TABLE 11

Sequences of DNA substrates used in in vitro PAM cleavage assay

| Guide* | | DNA Sequence | SEQ ID NO |
|---|---|---|---|
| 7.37 TS | TTC PAM | AGCGCGAGCACAGCTAAGGCCACGGAGCGAGACATCTCGGCCCGAATGCTGTCAGCTTCA | 1068 |
| 7.37 NTS | TTC PAM | TGAAGCTGACAGCATTCGGGCCGAGATGTCTCGCTCCGTGGCCTTAGCTGTGCTCGCGCT | 1069 |
| 7.37 TS | CTC PAM | AGCGCGAGCACAGCTAAGGCCACGGAGCGAGACATCTCGGCCCGAGTGCTGTCAGCTTCA | 1070 |
| 7.37 NTS | CTC PAM | TGAAGCTGACAGCACTCGGGCCGAGATGTCTCGCTCCGTGGCCTTAGCTGTGCTCGCGCT | 1071 |
| 7.37 TS | GTC PAM | AGCGCGAGCACAGCTAAGGCCACGGAGCGAGACATCTCGGCCCGACTGCTGTCAGCTTCA | 1072 |

TABLE 11-continued

Sequences of DNA substrates used in in vitro PAM cleavage assay

| Guide* | DNA Sequence | SEQ ID NO |
|---|---|---|
| 7.37 GTC PAM NTS | TGAAGCTGACAGCAGTCGGGCCGAGATGTCTCGCTCCGTGGCCTTAGCTGTGCTCGCGCT | 1073 |
| 7.37 ATC PAM TS | AGCGCGAGCACAGCTAAGGCCACGGAGCGAGACATCTCGGCCCGATTGCTGTCAGCTTCA | 1074 |
| 7.37 ATC PAM NTS | TGAAGCTGACAGCAATCGGGCCGAGATGTCTCGCTCCGTGGCCTTAGCTGTGCTCGCGCT | 1075 |

*The PAM sequences for each are bolded.
TS—target strand.
NTS—Non-target strand

TABLE 12

Apparent cleavage rates of CasX variants against NTC PAMs

| Variant | TTC | CTC | GTC | ATC |
|---|---|---|---|---|
| 2 | 0.267 min$^{-1}$ | 9.29E-3 min$^{-1}$ (0.035) | 3.75E-3 min$^{-1}$ (0.014) | 1.87E-2 min$^{-1}$ (0.070) |
| 119 | 8.33 min$^{-1}$ | 0.303 min$^{-1}$ (0.036) | 8.64E-2 min$^{-1}$ (0.010) | 0.540 min$^{-1}$ (0.065) |
| 438 | 4.94 min$^{-1}$ | 0.212 min$^{-1}$ (0.043) | 1.31E-2 min$^{-1}$ (0.013) | 0.408 min$^{-1}$ (0.083) |
| 491 | 16.42 min$^{-1}$ | 8.605 min$^{-1}$ (0.524) | 2.447 min$^{-1}$ (0.149) | 11.33 min$^{-1}$ (0.690) |

2. Comparison of PAM Recognition Using Single CasX Variant

Materials and Methods: Fluorescently labeled dsDNA targets with a 7.37 spacer and either a TTC, CTC, GTC, ATC, TTT, CTT, GTT, or ATT PAM were used (sequences are in Table 13). Oligos were ordered with a 5' amino modification and labeled with a Cy7.5 NHS ester for target strand oligos and a Cy5.5 NHS ester for non-target strand oligos. dsDNA targets were formed by mixing the oligos in a 1:1 ratio in 1× cleavage buffer (20 mM Tris HCl pH 7.5, 150 mM NaCl, 1 mM TCEP, 5% glycerol, 10 mM MgCl2), heating to 95° C. for 10 minutes, and allowing the solution to cool to room temperature.

CasX variant 491 was complexed with sg174.7.37. The guide was diluted in 1× cleavage buffer to a final concentration of 1.5 µM, and then protein was added to a final concentration of 1 µM. The RNP was incubated at 37° C. for 10 minutes and then put on ice.

Cleavage assays were carried out by diluting RNP in cleavage buffer to a final concentration of 200 nM and adding dsDNA target to a final concentration of 10 nM. Time points were taken at 0.25, 0.5, 1, 2, 5, and 10 minutes and quenched by adding to an equal volume of 95% formamide and 20 mM EDTA. Cleavage products were resolved by running on a 10% urea-PAGE gel. Gels were imaged with an Amersham Typhoon and quantified using the IQTL 8.2 software. Apparent first-order rate constants for non-target strand cleavage (kcleave) were determined for each target using GraphPad Prism.

Results:

The relative cleavage rate of the 491.174 RNP on various PAMs was investigated. In addition to aiding in the prediction of cleavage efficiencies of targets and potential off-targets in cells, these data will also allow us to adjust the cleavage rate of synthetic targets. In the case of self-limiting AAV vectors, where new protospacers can be added within the vector to allow for self-targeting, we reasoned that the rate of episome cleavage could be adjusted up or down by changing the PAM.

Figure 11A:
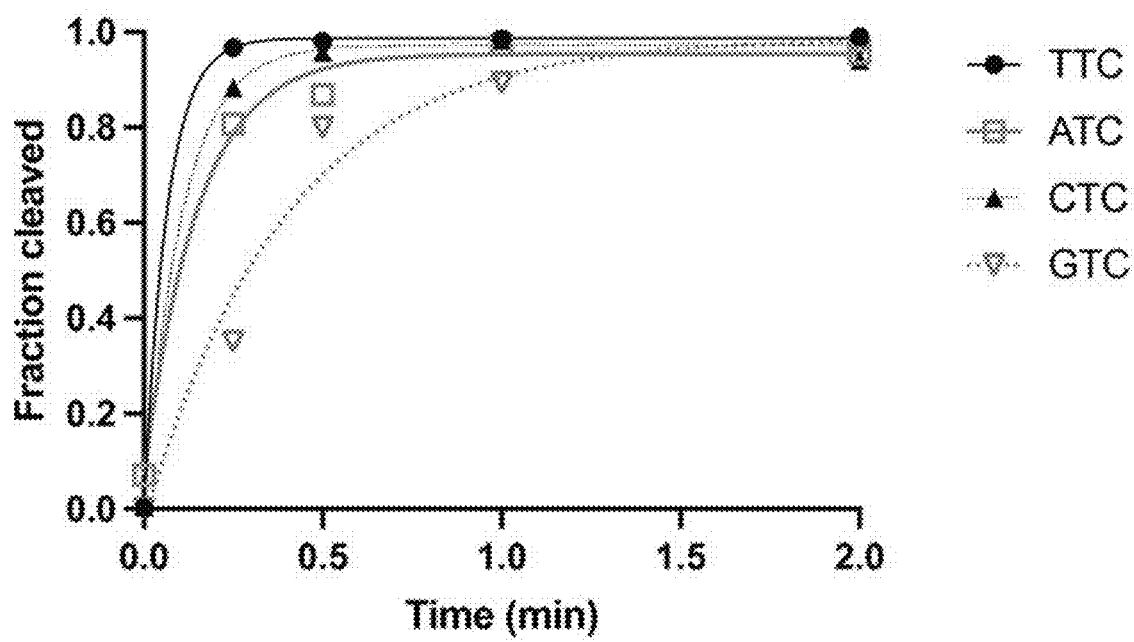
FIG. 11A shows the quantification of cleavage rates of RNP of CasX variant 491 and guide 174 on NTC PAMs, as described in Example 5. Timepoints were taken over the course of 2 minutes and the fraction cleaved was graphed for each target and timepoint, but only the first two minutes of the time course are shown for clarity.
Figure 11B:
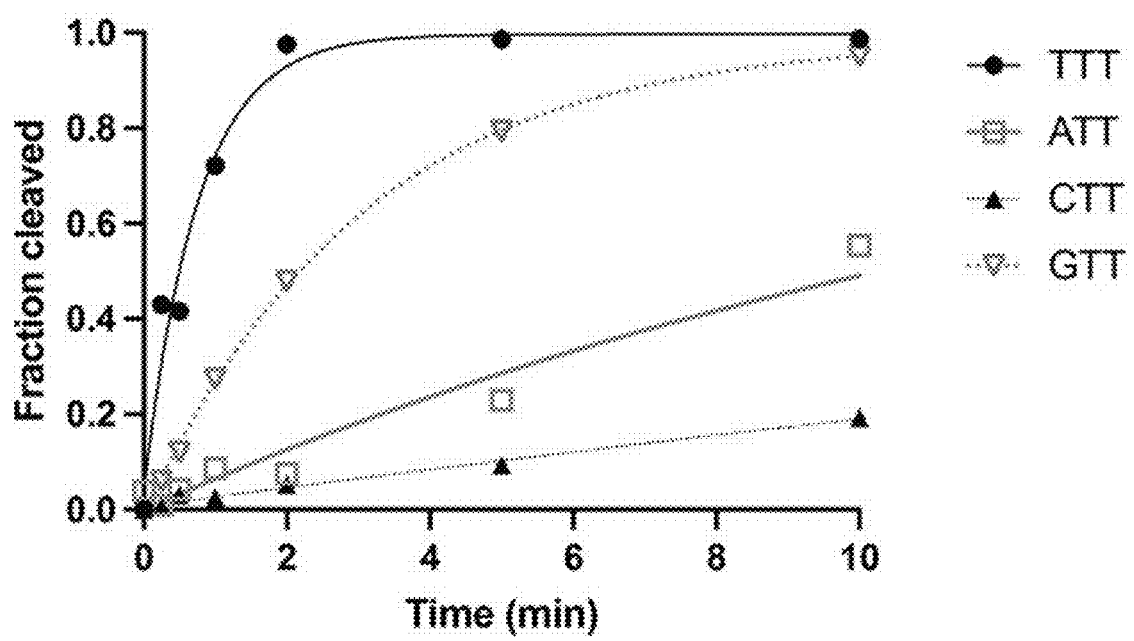
FIG. 11B shows the quantification of cleavage rates of RNP of CasX variant 491 and guide 174 on NTT PAMs, as described in Example 5. Timepoints were taken over the course of 10 minutes and the fraction cleaved was graphed for each target and timepoint.

We tested the cleavage rate of the RNP against various dsDNA substrates that were identical in sequence aside from the PAM. This experimental setup should allow for the isolation of the effects of the PAM itself, rather than convoluting PAM recognition with effects resulting from spacer sequence and genomic context. All NTC and NTT PAMs were tested. As expected, the RNP cleaved the target with the TTC PAM most quickly, converting essentially all of it to product by the first time point (FIG. 11A). CTC was cleaved roughly half as quickly, though the rapid cleavage of TTC makes determining an accurate kcleave difficult under these assay conditions, which are optimized to capture a broader array of cleavage rates (FIG. 11A, Table 14). The GTC target was cleaved most slowly of the NTC PAMs, with a cleavage rate roughly six-fold slower than the TTC target. All NTT PAMs were cleaved more slowly than all NTC PAMs, with TTT cut most efficiently, followed by GTT (FIG. 11B, Table 14). The relative efficiency of GTT cleavage among all NTT PAMs, compared to the low rate of GTC cleavage compared to all NTC PAMs, demonstrates that recognition of individual PAM nucleotides is context-dependent, with nucleotide identity at one position in the PAM affecting sequence preference at the other positions.

The PAM sequences tested here yield cleavage rates spanning three orders of magnitude while still maintaining cleavage activity at the same spacer sequence. These data demonstrate that cleavage rates at a given synthetic target can be readily modified by changing the associated PAM, allowing for adjustment of self-cleavage activity to allow for efficient targeting of the genomic target prior to cleavage and elimination of the AAV episome.

TABLE 13

Sequences of DNA substrates used in in vitro PAM cleavage assay*

| PAM & Strand | Spacer and PAM Sequence | SEQ ID NO |
|---|---|---|
| 7.37 TTC PAM TS | AGCGCGAGCACAGCTAAGGCCACGGAGCGAGACATCTCGGCCCGAATGCTGTCAGCTTCA | 1068 |

TABLE 13-continued

Sequences of DNA substrates used in in vitro PAM cleavage assay*

| PAM & Strand | Spacer and PAM Sequence | SEQ ID NO |
|---|---|---|
| 7.37 TTC PAM NTS | TGAAGCTGACAGCATTCGGGCCGAGATGTCTCGCTCCGTGGCCTTAGCTGTGCTCGCGCT | 1069 |
| 7.37 CTC PAM TS | AGCGCGAGCACAGCTAAGGCCACGGAGCGAGACATCTCGGCCCGAGTGCTGTCAGCTTCA | 1070 |
| 7.37 CTC PAM NTS | TGAAGCTGACAGCACTCGGGCCGAGATGTCTCGCTCCGTGGCCTTAGCTGTGCTCGCGCT | 1071 |
| 7.37 GTC PAM TS | AGCGCGAGCACAGCTAAGGCCACGGAGCGAGACATCTCGGCCCGACTGCTGTCAGCTTCA | 1072 |
| 7.37 GTC PAM NTS | TGAAGCTGACAGCAGTCGGGCCGAGATGTCTCGCTCCGTGGCCTTAGCTGTGCTCGCGCT | 1073 |
| 7.37 ATC PAM TS | AGCGCGAGCACAGCTAAGGCCACGGAGCGAGACATCTCGGCCCGATTGCTGTCAGCTTCA | 1074 |
| 7.37 ATC PAM NTS | TGAAGCTGACAGCAATCGGGCCGAGATGTCTCGCTCCGTGGCCTTAGCTGTGCTCGCGCT | 1075 |
| 7.37 TTT PAM TS | AGCGCGAGCACAGCTAAGGCCACGGAGCGAGACATCTCGGCCCAAATGCTGTCAGCTTCA | 1076 |
| 7.37 TTT PAM NTS | TGAAGCTGACAGCATTTGGGCCGAGATGTCTCGCTCCGTGGCCTTAGCTGTGCTCGCGCT | 1077 |
| 7.37 CTT PAM TS | AGCGCGAGCACAGCTAAGGCCACGGAGCGAGACATCTCGGCCCTAGTGCTGTCAGCTTCA | 1078 |
| 7.37 CTT PAM NTS | TGAAGCTGACAGCACTTGGGCCGAGATGTCTCGCTCCGTGGCCTTAGCTGTGCTCGCGCT | 1079 |
| 7.37 GTT PAM TS | AGCGCGAGCACAGCTAAGGCCACGGAGCGAGACATCTCGGCCCTACTGCTGTCAGCTTCA | 1080 |
| 7.37 GTT PAM NTS | TGAAGCTGACAGCAGTTGGGCCGAGATGTCTCGCTCCGTGGCCTTAGCTGTGCTCGCGCT | 1081 |
| 7.37 ATT PAM TS | AGCGCGAGCACAGCTAAGGCCACGGAGCGAGACATCTCGGCCCTATTGCTGTCAGCTTCA | 1082 |
| 7.37 ATT PAM NTS | TGAAGCTGACAGCAATTGGGCCGAGATGTCTCGCTCCGTGGCCTTAGCTGTGCTCGCGCT | 1083 |

*The DNA sequences used to generate each dsDNA substrate are shown. The PAM sequences for each are bolded.
TS—target strand.
NTS—Non-target strand.

TABLE 14

Apparent cleavage rates of CasX 491.174 against NTC and NTT PAMs

| PAM | TTC | ATC | CTC | GTC | TTT | ATT | CTT | GTT |
|---|---|---|---|---|---|---|---|---|
| $k_{cleave}$ (min$^{-1}$) | 15.6* | 6.66 | 9.45 | 2.52 | 1.33 | 0.0675 | 0.0204 | 0.330 |

*The rate of TTC cleavage exceeds the resolution of this assay, so the resulting $k_{cleave}$ should be taken as a lower bound.

Example 6: Assessing Nuclease Activity for Double-Strand Cleavage

Purified wild-type and engineered CasX variants will be complexed with single-guide RNA bearing a fixed HRS targeting sequence. The RNP complexes will be added to buffer containing MgCl2 at a final concentration of 100 nM and incubated with double-stranded target DNA with a 5' Cy7.5 label on either the target or non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the cleavage rates of the target and non-target strands by the wild-type and engineered variants will be determined. To more clearly differentiate between changes to target binding vs the rate of catalysis of the nucleolytic reaction itself, the protein concentration will be titrated over a range from 10 nM to 1 uM and cleavage rates will be determined at each concentration to generate a pseudo-Michaelis-Menten fit and determine the kcat* and KM*. Changes to KM* are indicative of altered binding, while changes to kcat* are indicative of altered catalysis.

Example 7: The PASS Assay Identifies CasX Protein Variants of Differing PAM Sequence Specificity Experiments were conducted to identify the PAM sequence specificities of CasX proteins 2 (SEQ ID NO: 2), 491, 515, 533, 535, 668, and 672. To accomplish this, the HEK293 cell line PASS_V1.01 or PASS_V1.02 was treated with the above CasX proteins in at least two replicate experiments, and Next-generation sequencing (NGS) was performed to calculate the percent editing using a variety of spacers at their intended target sites.

Materials and Methods: A multiplexed pooled approach was taken to assay clonal protein variants using the PASS system. Briefly, two pooled HEK293 cell lines were generated and termed PASS_V1.01 and PASS_V1.02. Each cell within the pool contained a genome-integrated single-guide RNA (sgRNA), paired with a specific target site. After transfection of protein-expression constructs, editing at a specific target by a specific spacer could be quantified by NGS. Each guide-target pair was designed to provide data related to activity, specificity, and targetability of the CasX-guide RNP complex.

Paired spacer-target sequences were synthesized by Twist Biosciences and obtained as an equimolar pool of oligonucleotides. This pool was amplified by PCR and cloned by Golden Gate cloning to generate a final library of plasmids named p77. Each plasmid contained a sgRNA expression element and a target site, along with a GFP expression element. The sgRNA expression element consisted of a U6 promoter driving transcription of gRNA scaffold 174 (SEQ ID NO: 2238), followed by a spacer sequence which would target the RNP of the guide and CasX variant to the intended target site. 250 possible unique, paired spacer-target synthetic sequences were designed and synthesized. A pool of lentivirus was then produced from this plasmid library using the LentiX production system (Takara Bio USA, Inc) according to the manufacturer's instructions. The resulting viral preparation was then quantified by qPCR and transduced into a standard HEK293 cell line at a low multiplicity of infection so as to generate single copy integrations. The resulting cell line was then purified by fluorescence-activated cell sorting (FACS) to complete the production of PASS_V1.01 or PASS_V1.02. A cell line was then seeded in six-well plate format and treated in duplicate with either water or was transfected with 2 μg of plasmid p67, delivered by Lipofectamine™ Transfection Reagent (ThermoFisher) according to the manufacturer's instructions. Plasmid p67 contains an EF-1 alpha promoter driving expression of a CasX protein tagged with the SV40 Nuclear Localization Sequence. After two days, treated cells were collected, lysed, and genomic DNA was extracted using a genomic DNA isolation kit (Zymo Research). Genomic DNA was then PCR amplified with custom primers to generate amplicons compatible with Illumina NGS and sequenced on a NextSeq instrument. Sample reads were demultiplexed and filtered for quality. Editing outcome metrics (fraction of reads with indels) were then quantified for each spacer-target synthetic sequence across treated samples.

To assess the PAM sequence specificity for a CasX protein, editing outcome metrics for four different PAM sequences were categorized. For TTC PAM target sites, 48 different spacer-target pairs were quantified; for ATC, CTC, and GTC PAM target sites, 14, 22, and 11 individual target sites were quantified, respectively. For some CasX proteins, replicate experiments were repeated dozens of times over several months. For each of these experiments, the average editing efficiency was calculated for each of the above described spacers. The average editing efficiency across the four categories of PAM sequence was then calculated from all such experiments, along with the standard deviation of these measurements.

Results: Table 15 lists the average editing efficiency across PAM categories and across CasX protein variants, along with the standard deviation of these measurements. The number of measurements for each category is also indicated. These data indicate that the engineered CasX variants 491 and 515 are specific for the canonical PAM sequence TTC, while other engineered variants of CasX performed more or less efficiently at the PAM sequences tested. In particular, the average rank order of PAM preferences for CasX 491 is TTC>>ATC>CTC>GTC, or TTC>>ATC>GTC>CTC for CasX 515, while the wild-type CasX 2 exhibits an average rank order of TTC>>GTC>CTC>ATC. Note that for the lower editing PAM sequences the error of these average measurements is high. In contrast, CasX variants 535, 668, and 672 have considerably broader PAM recognition, with a rank order of TTC>CTC>ATC>GTC. Finally, CasX 533 exhibits a completely re-ordered ranking relative to the WT CasX, ATC>CTC>>GTC>TTC. These data can be used to engineer maximally-active therapeutic CasX molecules for a target DNA sequence of interest.

Under the conditions of the experiments, a set of CasX proteins was identified that are improved for double-stranded DNA cleavage in human cells at target DNA sequences associated with a PAM of sequence TTC, ATC, CTC, or GTC, supporting that CasX variants with an altered spectrum of PAM specificity, relative

TABLE 15

Average editing of selected CasX Proteins at spacers associated with PAM sequences of TTC, ATC, CTC, or GTC

| CasX Name | PAM Sequence | Average Percent Editing | Standard Deviation | Number of Measurements |
|---|---|---|---|---|
| 2 | ATC | 0.40 | 1.35 | 336 |
| 2 | CTC | 0.46 | 2.29 | 528 |
| 2 | GTC | 0.69 | 6.27 | 264 |
| 2 | TTC | 5.28 | 7.34 | 1152 |
| 491 | ATC | 6.86 | 8.29 | 364 |
| 491 | CTC | 4.54 | 6.40 | 572 |
| 491 | GTC | 3.40 | 6.68 | 286 |
| 491 | TTC | 40.41 | 23.13 | 1248 |
| 515 | ATC | 4.47 | 5.49 | 252 |
| 515 | CTC | 3.36 | 4.80 | 396 |
| 515 | GTC | 3.65 | 10.75 | 198 |
| 515 | TTC | 36.75 | 24.89 | 864 |
| 533 | ATC | 47.50 | 15.86 | 96 |
| 533 | CTC | 25.90 | 14.74 | 28 |
| 533 | GTC | 6.34 | 8.36 | 44 |
| 533 | TTC | 0.87 | 3.05 | 22 |
| 535 | ATC | 9.70 | 10.20 | 56 |
| 535 | CTC | 11.77 | 13.59 | 88 |
| 535 | GTC | 7.62 | 15.04 | 44 |
| 535 | TTC | 29.29 | 18.78 | 192 |
| 668 | ATC | 44.69 | 24.40 | 56 |
| 668 | CTC | 46.14 | 26.57 | 88 |
| 668 | GTC | 30.48 | 24.06 | 44 |
| 668 | TTC | 55.34 | 28.59 | 192 |
| 672 | ATC | 25.51 | 20.85 | 56 |
| 672 | CTC | 30.05 | 22.95 | 88 |
| 672 | GTC | 14.21 | 13.38 | 44 |
| 672 | TTC | 52.36 | 27.64 | 192 |

Example 8: CasX:gRNA In Vitro Cleavage Assays

1. Assembly of RNP

Purified wild-type and RNP of CasX and single guide RNA (sgRNA) were either prepared immediately before experiments or prepared and snap-frozen in liquid nitrogen and stored at −80° C. for later use. To prepare the RNP complexes, the CasX protein was incubated with sgRNA at 1:1.2 molar ratio. Briefly, sgRNA was added to Buffer #1 (25 mM NaPi, 150 mM NaCl, 200 mM trehalose, 1 mM MgCl2), then the CasX was added to the sgRNA solution, slowly with swirling, and incubated at 37° C. for 10 mM to form RNP complexes. RNP complexes were filtered before use through a 0.22 µm Costar 8160 filters that were pre-wet with 200 µl Buffer #1. If needed, the RNP sample was concentrated with a 0.5 ml Ultra 100-Kd cutoff filter, (Millipore part #UFC510096), until the desired volume was obtained. Formation of competent RNP was assessed as described below.

2. Determining Cleavage-Competent Fractions for Protein Variants Compared to Wild-Type Reference CasX The ability of CasX variants to form active RNP compared to reference CasX was determined using an in vitro cleavage assay. The beta-2 microglobulin (B2M) 7.37 target for the cleavage assay was created as follows. DNA oligos with the sequence TGAAGCTGACAGCATTCGGGCCGAGATGTCTCGCTCCGTGGCCT-TAGCTGTGCTCGC GCT (non-target strand, NTS (SEQ ID NO: 1069)) and AGCGCGAGCACAGCTAAGGC-CACGGAGCGAGA-CATCTCGGCCCGAATGCTGTCAGC TTCA (target strand, TS (SEQ ID NO: 1068)) were purchased with 5' fluorescent labels (LI-COR IRDye 700 and 800, respectively). dsDNA targets were formed by mixing the oligos in a 1:1 ratio in 1× cleavage buffer (20 mM Tris HCl pH 7.5, 150 mM NaCl, 1 mM TCEP, 5% glycerol, 10 mM MgCl$_2$), heating to 95° C. for 10 minutes, and allowing the solution to cool to room temperature.

CasX RNPs were reconstituted with the indicated CasX and guides (see graphs) at a final concentration of 1 µM with 1.5-fold excess of the indicated guide unless otherwise specified in 1× cleavage buffer (20 mM Tris HCl pH 7.5, 150 mM NaCl, 1 mM TCEP, 5% glycerol, 10 mM MgCl$_2$) at 37° C. for 10 mM before being moved to ice until ready to use. The 7.37 target was used, along with sgRNAs having spacers complementary to the 7.37 target.

Cleavage reactions were prepared with final RNP concentrations of 100 nM and a final target concentration of 100 nM. Reactions were carried out at 37° C. and initiated by the addition of the 7.37 target DNA. Aliquots were taken at 5, 10, 30, 60, and 120 minutes and quenched by adding to 95% formamide, 20 mM EDTA. Samples were denatured by heating at 95° C. for 10 minutes and run on a 10% urea-PAGE gel. The gels were either imaged with a LI-COR Odyssey CLx and quantified using the LI-COR Image Studio software or imaged with a Cytiva Typhoon and quantified using the Cytiva IQTL software. The resulting data were plotted and analyzed using Prism. We assumed that CasX acts essentially as a single-turnover enzyme under the assayed conditions, as indicated by the observation that sub-stoichiometric amounts of enzyme fail to cleave a greater-than-stoichiometric amount of target even under extended time-scales and instead approach a plateau that scales with the amount of enzyme present. Thus, the fraction of target cleaved over long time-scales by an equimolar amount of RNP is indicative of what fraction of the RNP is properly formed and active for cleavage. The cleavage traces were fit with a biphasic rate model, as the cleavage reaction clearly deviates from monophasic under this concentration regime, and the plateau was determined for each of three independent replicates. The mean and standard deviation were calculated to determine the active fraction (Table 16).

Figure 1:
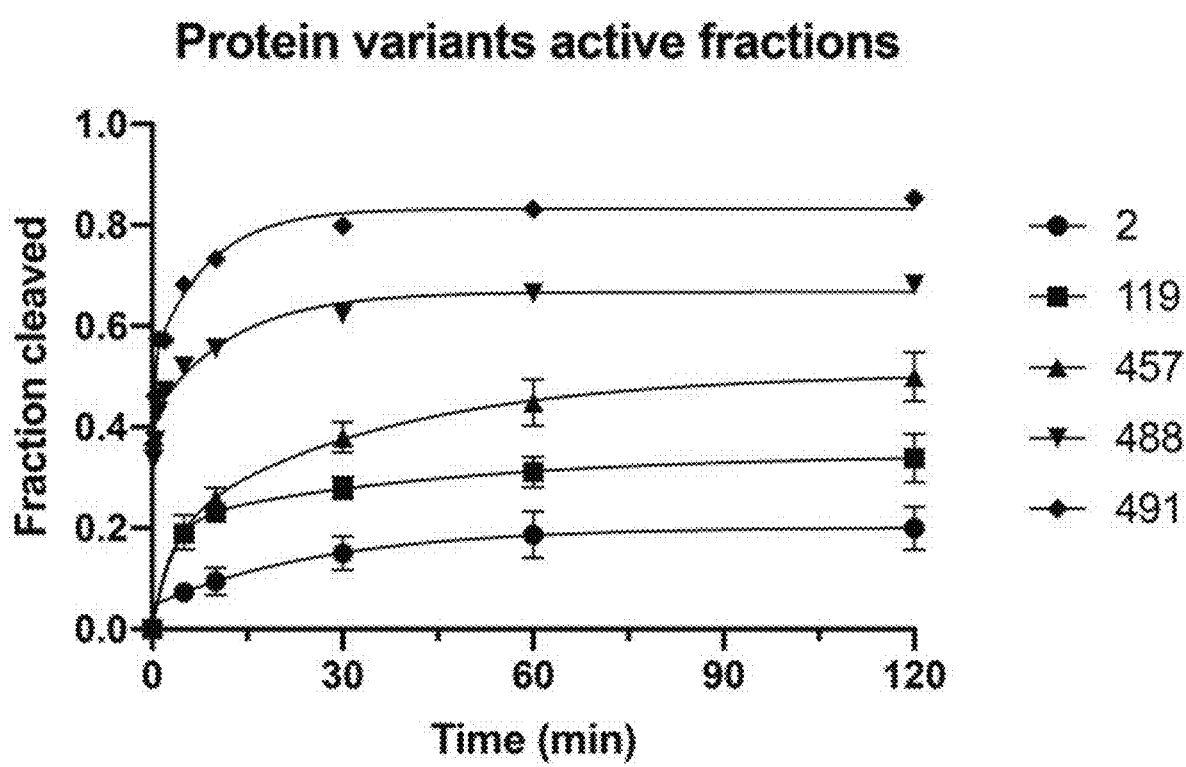
FIG. 1 is a graph of the results of an assay for the quantification of active fractions of RNP formed by sgRNA174 (SEQ ID NO: 2238) and the CasX variants 119, 457, 488 and 491, as described in Example 8. Sequences corresponding to sgRNAs and CasX variants are provided in Tables 2 and 3, respectively. Equimolar amounts of RNP and target were co-incubated and the amount of cleaved target was determined at the indicated timepoints. Mean and standard deviation of three independent replicates are shown for each timepoint. The biphasic fit of the combined replicates is shown. "2" refers to the reference CasX protein of SEQ ID NO: 2.

Apparent active (competent) fractions were determined for RNPs formed for CasX2+ guide 174+7.37 spacer, CasX119+guide 174+7.37 spacer, CasX457+guide 174+7.37 spacer, CasX488+guide 174+7.37 spacer, and CasX491+guide 174+7.37 spacer as shown in FIG. 1. The determined active fractions are shown in Table 16. All CasX variants had higher active fractions than the wild-type CasX2, indicating that the engineered CasX variants form significantly more active and stable RNP with the identical guide under tested conditions compared to wild-type CasX. This may be due to an increased affinity for the sgRNA, increased stability or solubility in the presence of sgRNA, or greater stability of a cleavage-competent conformation of the engineered CasX: sgRNA complex. An increase in solubility of the RNP was indicated by a notable decrease in the observed precipitate formed when CasX457, CasX488, or CasX491 was added to the sgRNA compared to CasX2.

Figure 2:
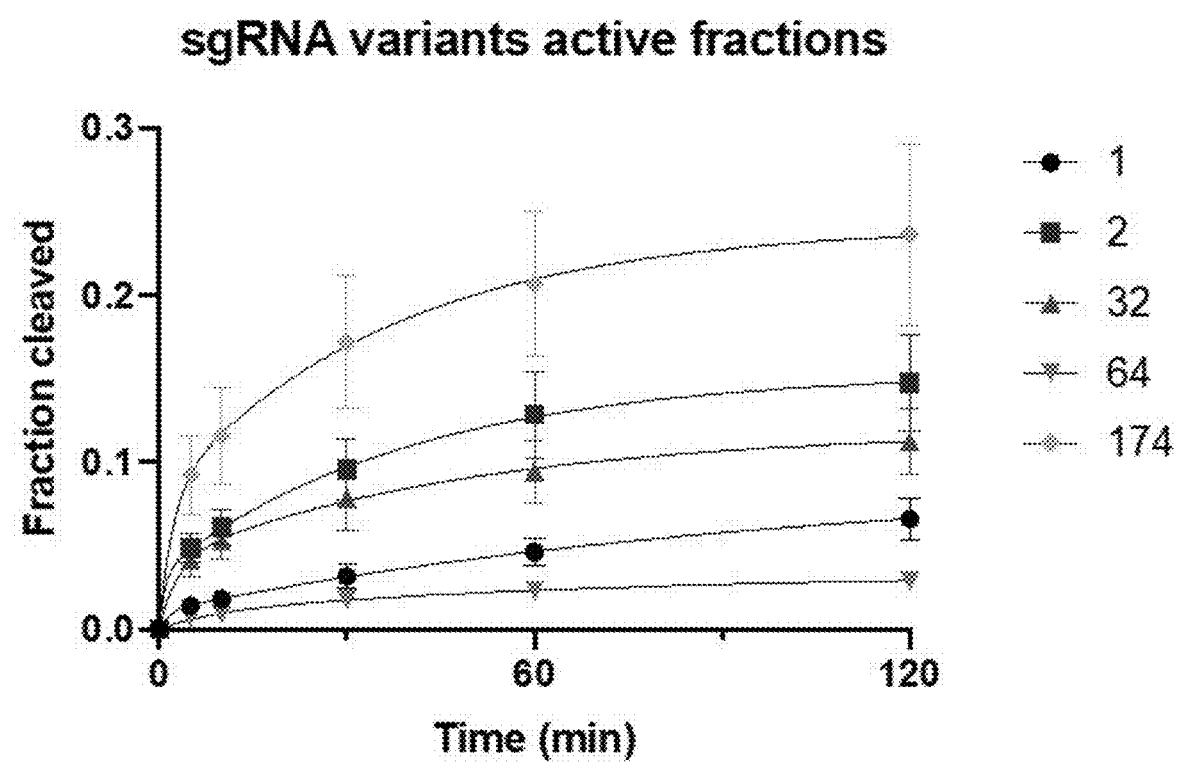
FIG. 2 shows the quantification of active fractions of RNP formed by CasX2 (reference CasX protein of SEQ ID NO: 2) and the modified sgRNAs, as described in Example 8. Equimolar amounts of RNP and target were co-incubated and the amount of cleaved target was determined at the indicated timepoints. Mean and standard deviation of three independent replicates are shown for each timepoint. The biphasic fit of the combined replicates is shown.

3. In Vitro Cleavage Assays—Determining Cleavage-Competent Fractions for Single Guide Variants Relative to Reference Single Guides Cleavage-competent fractions were also determined using the same protocol for CasX2.2.7.37, CasX2.32.7.37, CasX2.64.7.37, and CasX2.174.7.37 to be 16±3%, 13±3%, 5±2%, and 22±5%, as shown in FIG. 2 and Table 16.

Figure 3:
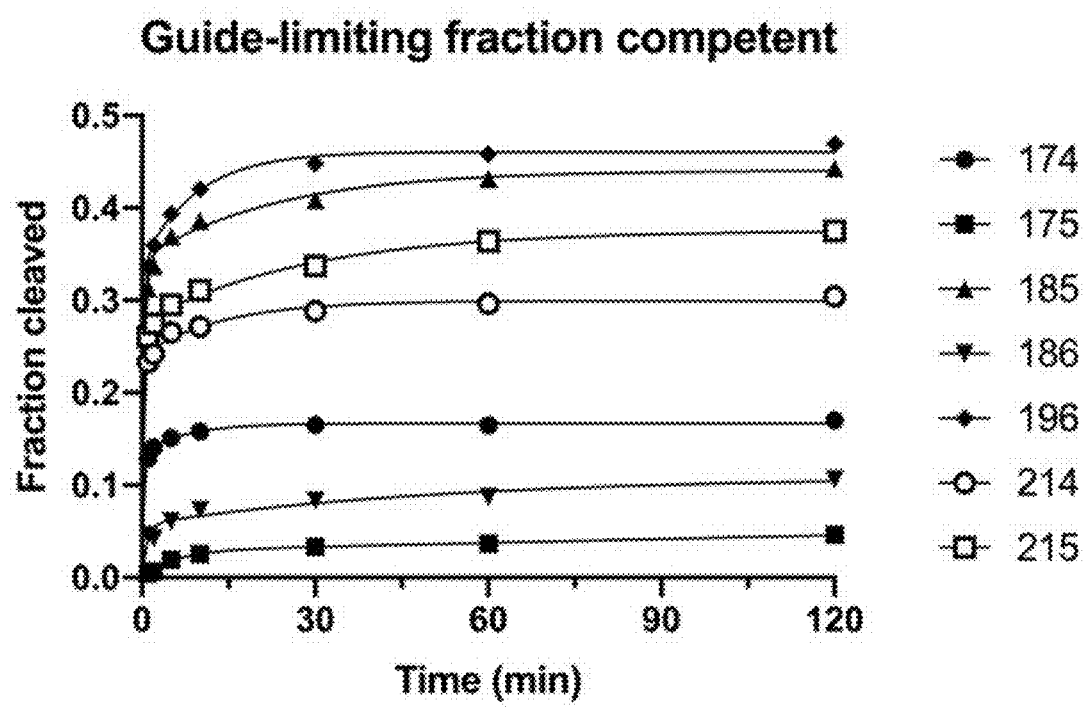
FIG. 3 shows the quantification of active fractions of RNP formed by CasX 491 and the modified sgRNAs under guide-limiting conditions, as described in Example 8. Equimolar amounts of RNP and target were co-incubated and the amount of cleaved target was determined at the indicated timepoints. The biphasic fit of the data is shown.

A second set of guides were tested under different conditions to better isolate the contribution of the guide to RNP formation. Guides 174, 175, 185, 186, 196, 214, and 215 with 7.37 spacer were mixed with CasX 491 at final concentrations of 1 µM for the guide and 1.5 µM for the protein, rather than with excess guide as before. Results are shown in FIG. 3 and Table 16. Many of these guides exhibited additional improvement over 174, with 185 and 196 achieving 91±4% and 91±1% competent fractions, respectively, compared with 80±9% for 174 under these guide-limiting conditions.

The data indicate that both CasX variants and sgRNA variants are able to form a higher degree of active RNP with guide RNA compared to wild-type CasX and wild-type sgRNA.

The apparent cleavage rates of CasX variants 119, 457, 488, and 491 compared to wild-type reference CasX were determined using an in vitro fluorescent assay for cleavage of the target 7.37.

4. In Vitro Cleavage Assays—Determining $k_{cleave}$ for CasX Variants Compared to Wild-Type Reference CasX CasX RNPs were reconstituted with the indicated CasX (see FIG. 4) at a final concentration of 1 µM with 1.5-fold excess of the indicated guide in 1× cleavage buffer (20 mM Tris HCl pH 7.5, 150 mM NaCl, 1 mM TCEP, 5% glycerol, 10 mM MgCl$_2$) at 37° C. for 10 min before being moved to ice until ready to use. Cleavage reactions were set up with a final RNP concentration of 200 nM and a final target concentration of 10 nM. Reactions were carried out at 37° C. except where otherwise noted and initiated by the addition of the target DNA. Aliquots were taken at 0.25, 0.5, 1, 2, 5, and 10 minutes and quenched by adding to 95% formamide, 20 mM EDTA. Samples were denatured by heating at 95° C. for 10 minutes and run on a 10% urea-PAGE gel. The gels were imaged with a LI-COR Odyssey CLx and quantified using the LI-COR Image Studio software or imaged with a Cytiva Typhoon and quantified using the Cytiva IQTL software. The resulting data were plotted and analyzed using Prism, and the apparent first-order rate constant of non-target strand cleavage ($k_{cleave}$) was determined for each CasX:sgRNA combination replicate individually. The mean and standard deviation of three replicates with independent fits are presented in Table 16, and the cleavage traces are shown in FIG. 5.

Figure 4:
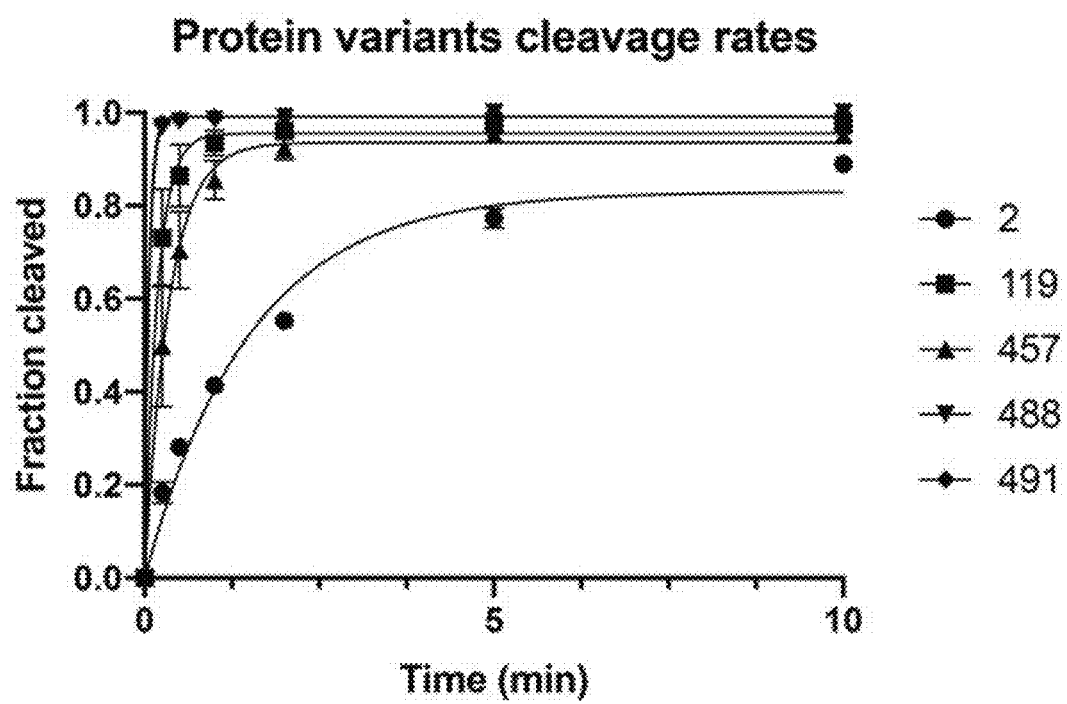
FIG. 4 shows the quantification of cleavage rates of RNP formed by sgRNA174 and the CasX variants, as described in Example 8. Target DNA was incubated with a 20-fold excess of the indicated RNP and the amount of cleaved target was determined at the indicated time points. Mean and standard deviation of three independent replicates are shown for each timepoint, except for 488 and 491 where a single replicate is shown. The monophasic fit of the combined replicates is shown.
Figure 5:
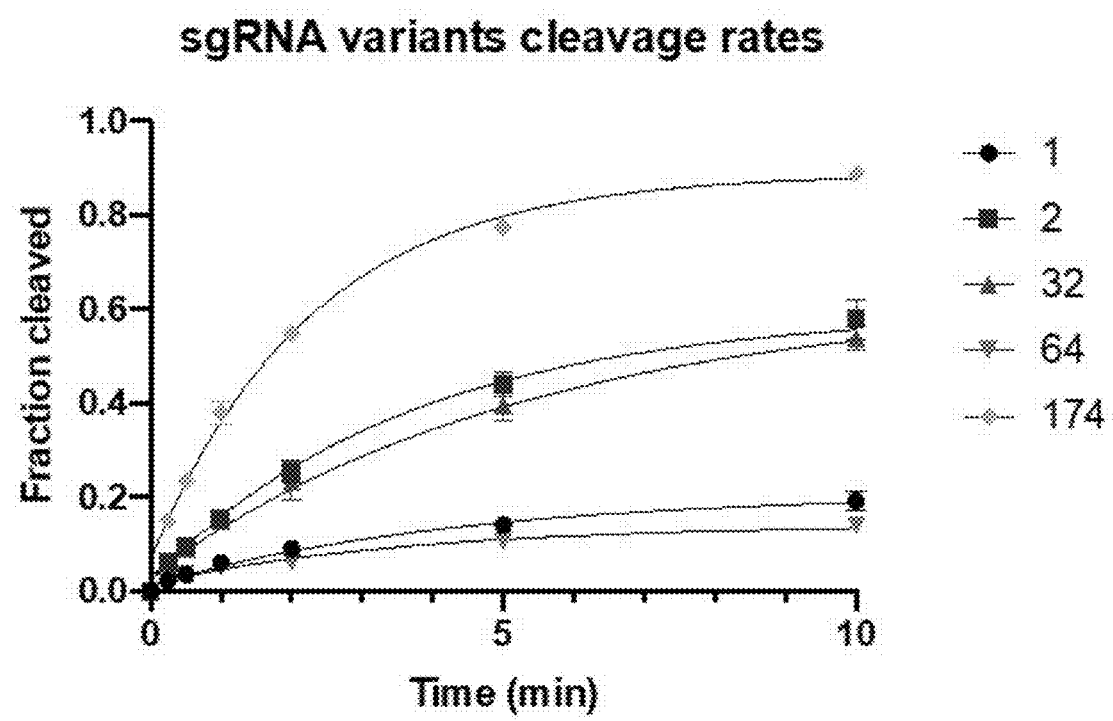
FIG. 5 shows the quantification of cleavage rates of RNP formed by CasX2 and the sgRNA variants, as described in Example 8. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.

Apparent cleavage rate constants were determined for wild-type CasX2, and CasX variants 119, 457, 488, and 491 with guide 174 and spacer 7.37 utilized in each assay (see Table 16 and FIG. 4). All CasX variants had improved cleavage rates relative to the wild-type CasX2. CasX 457 cleaved more slowly than 119, despite having a higher competent fraction as determined above. CasX 488 and CasX 491 had the highest cleavage rates by a large margin; as the target was almost entirely cleaved in the first timepoint, the true cleavage rate exceeds the resolution of this assay, and the reported $k_{cleave}$, should be taken as a lower bound.

The data indicate that the CasX variants have a higher level of activity, with $k_{cleave}$ rates reaching at least 30-fold higher compared to wild-type CasX2.

5. In Vitro Cleavage Assays: Comparison of Guide Variants to Wild-Type Guides

Cleavage assays were also performed with wild-type reference CasX2 and reference guide 2 compared to guide variants 32, 64, and 174 to determine whether the variants improved cleavage. The experiments were performed as described above. As many of the resulting RNPs did not approach full cleavage of the target in the time tested, we determined initial reaction velocities (V0) rather than first-order rate constants. The first two timepoints (15 and 30 seconds) were fit with a line for each CasX:sgRNA combination and replicate. The mean and standard deviation of the slope for three replicates were determined.

Figure 6:
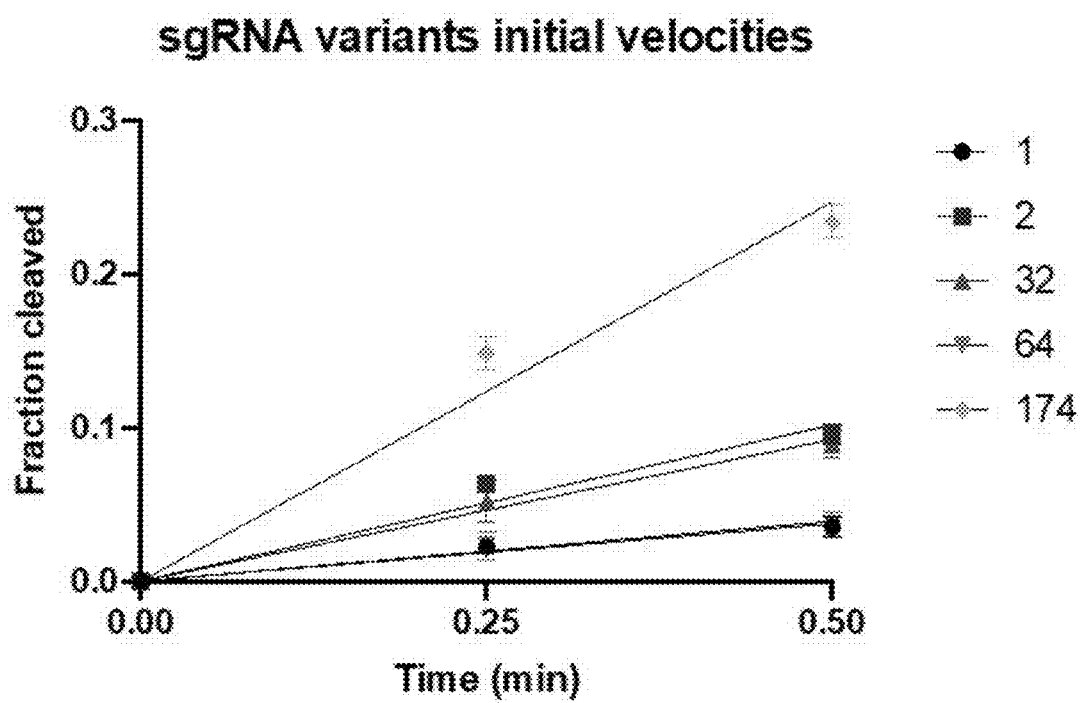
FIG. 6 shows the quantification of initial velocities of RNP formed by CasX2 and the sgRNA variants, as described in Example 8. The first two time-points of the previous cleavage experiment were fit with a linear model to determine the initial cleavage velocity.

Under the assayed conditions, the V0 for CasX2 with guides 2, 32, 64, and 174 were 20.4±1.4 nM/min, 18.4±2.4 nM/min, 7.8±1.8 nM/min, and 49.3±1.4 nM/min (see Table 16 and FIG. 5 and FIG. 6). Guide 174 showed substantial improvement in the cleavage rate of the resulting RNP (~2.5-fold relative to 2, see FIG. 6), while guides 32 and 64 performed similar to or worse than guide 2. Notably, guide 64 supports a cleavage rate lower than that of guide 2 but performs much better in vivo (data not shown). Some of the sequence alterations to generate guide 64 likely improve in vivo transcription at the cost of a nucleotide involved in triplex formation. Improved expression of guide 64 likely explains its improved activity in vivo, while its reduced stability may lead to improper folding in vitro.

Figure 7:
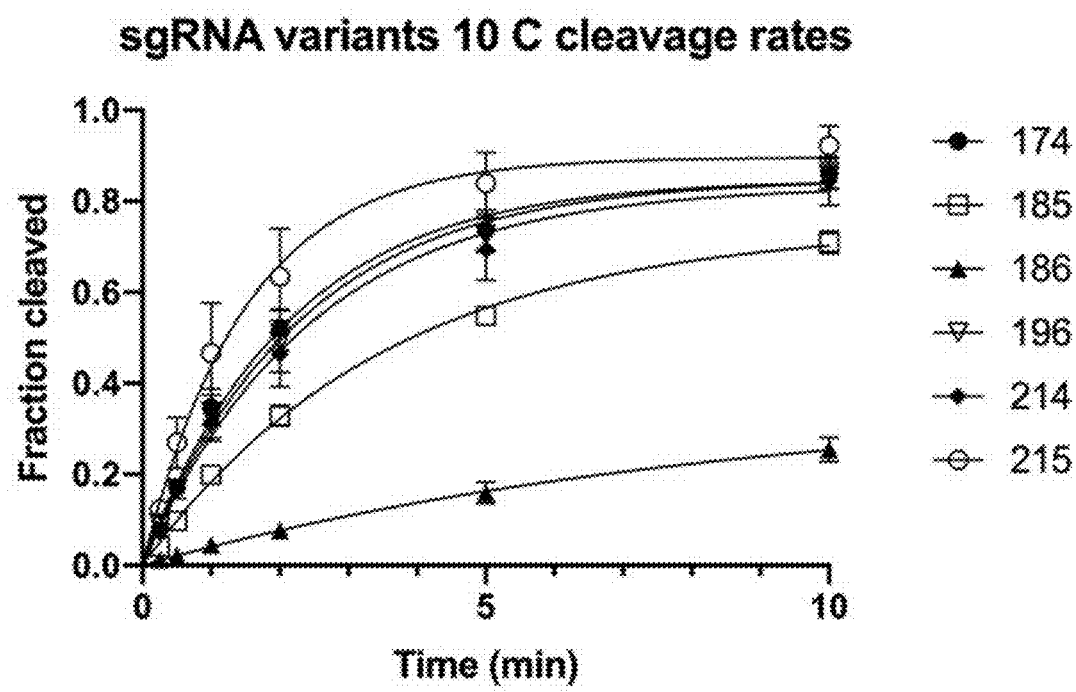
FIG. 7 shows the quantification of cleavage rates of RNP formed by CasX491 and the sgRNA variants, as described in Example 8. Target DNA was incubated with a 20-fold excess of the indicated RNP at 10° C. and the amount of cleaved target was determined at the indicated time points. The monophasic fit of the timepoints is shown.

Additional experiments were carried out with guides 174, 175, 185, 186, 196, 214, and 215 with spacer 7.37 and CasX 491 to determine relative cleavage rates. To reduce cleavage kinetics to a range measurable with our assay, the cleavage reactions were incubated at 10° C. Results are in FIG. 7 and Table 16. Under these conditions, 215 was the only guide that supported a faster cleavage rate than 174. 196, which exhibited the highest active fraction of RNP under guide-limiting conditions, had kinetics essentially the same as 174, again highlighting that different variants result in improvements of distinct characteristics.

The data support that, under the conditions of the assay, use of the majority of the guide variants with CasX results in RNP with a higher level of activity than one with the wild-type guide, with improvements in initial cleavage velocity ranging from −2-fold to >6-fold. Numbers in Table 16 indicate, from left to right, CasX variant, sgRNA scaffold, and spacer sequence of the RNP construct. In the RNP construct names in the table below, CasX protein variant, guide scaffold and spacer are indicated from left to right. 6. In vitro cleavage assays: Comparing cleavage rate and competent fraction of 515.174 and 526.174 against reference 2.2.

We wished to compare engineered protein CasX variants 515 and 526 in complex with engineered single-guide variant 174 against the reference wild-type protein 2 (SEQ ID NO:2) and minimally-engineered guide variant 2 (SEQ ID NO: 5). RNP complexes were assembled as described above, with 1.5-fold excess guide. Cleavage assays to determine $k_{cleave}$ and competent fraction were performed as described above, with both performed at 37° C., and with different timepoints used to determine the competent fraction for the wild-type vs engineered RNPs due to the significantly different times needed for the reactions to near completion.

Figure 8:
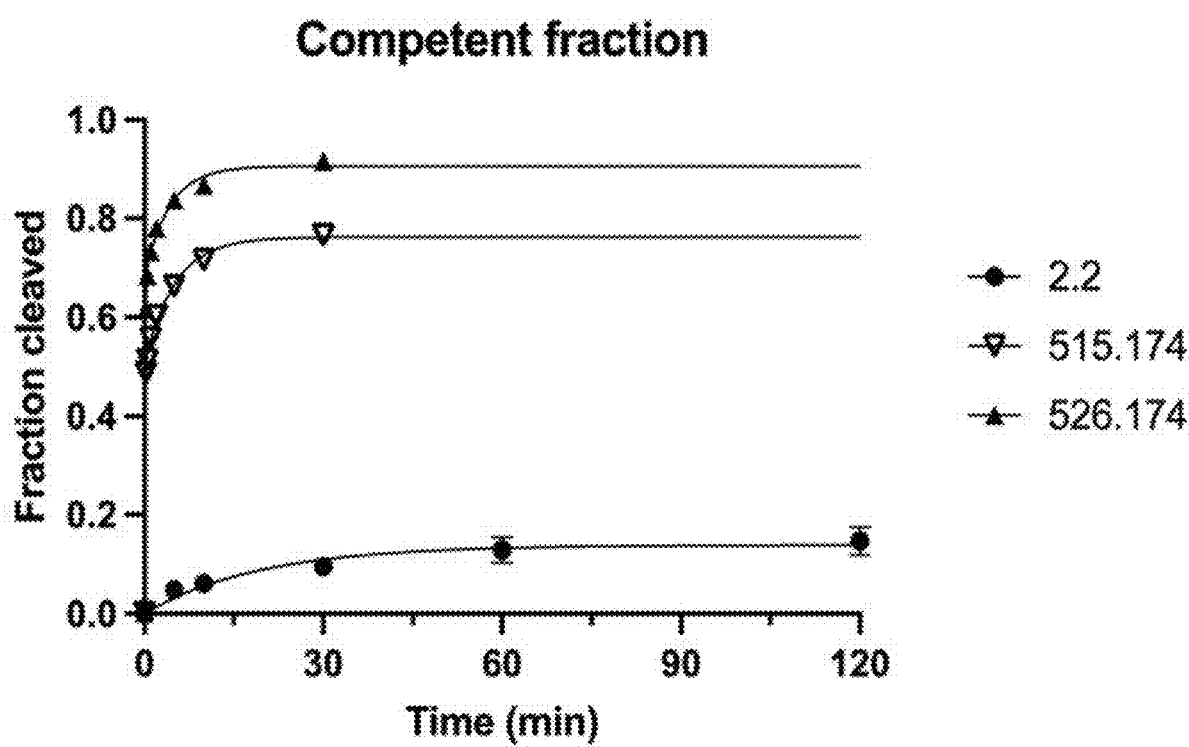
FIG. 8 shows the quantification of competent fractions of RNP of CasX variant 515 and 526 complexed with gRNA variant 174 compared to RNP of reference CasX 2 complexed with gRNA 2 using equimolar amounts of indicated RNP and a complementary target, as described in Example 8. The biphasic fit for each time course or set of combined replicates is shown.
Figure 9:
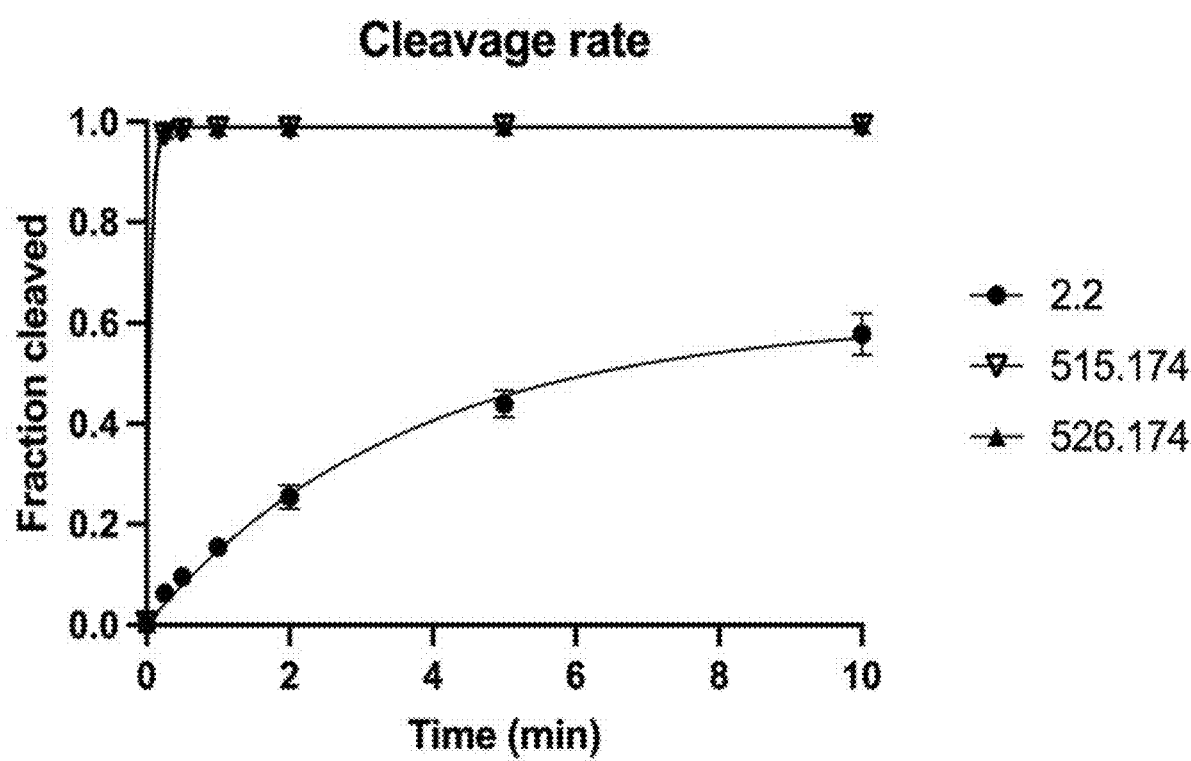
FIG. 9 shows the quantification of cleavage rates of RNP of CasX variant 515 and 526 complexed with gRNA variant 174 compared to RNP of reference CasX 2 complexed with gRNA 2 using with a 20-fold excess of the indicated RNP, as described in Example 8.

The resulting data clearly demonstrate the dramatic improvements made to RNP activity by engineering both protein and guide. RNPs of 515.174 and 526.174 had competent fractions of 76% and 91%, respectively, as compared to 16% for 2.2 (FIG. 8, Table 16). In the kinetic assay, both 515.174 and 526.174 cut essentially all of the target DNA by the first timepoint, exceeding the resolution of the assay and resulting in estimated cleavage rates of 17.10 and 19.87 $min^{-1}$, respectively (FIG. 9, Table 16). An RNP of 2.2, by contrast, cut on average less than 60% of the target DNA by the final 10-minute timepoint and has an estimated $k_{cleave}$ nearly two orders of magnitude lower than the engineered RNPs. The modifications made to the protein and guide have resulted in RNPs that are more stable, more likely to form active particles, and cut DNA much more efficiently on a per-particle basis as well.

TABLE 16

Results of cleavage and RNP formation assays

| RNP Construct | $k_{cleave}$* | Initial velocity* | Competent fraction |
|---|---|---|---|
| 2.2.7.37 | | 20.4 ± 1.4 nM/min | 16 ± 3% |
| 2.32.7.37 | | 18.4 ± 2.4 nM/min | 13 ± 3% |
| 2.64.7.37 | | 7.8 ± 1.8 nM/min | 5 ± 2% |
| 2.174.7.37 | 0.51 ± 0.01 $min^{-1}$ | 49.3 ± 1.4 nM/min | 22 ± 5% |
| 119.174.7.37 | 6.29 ± 2.11 $min^{-1}$ | | 35 ± 6% |
| 457.174.7.37 | 3.01 ± 0.90 $min^{-1}$ | | 53 ± 7% |
| 488.174.7.37 | 15.19 $min^{-1}$ | | 67% |
| 491.174.7.37 | 16.59 $min^{-1}$/0.293 $min^{-1}$ (10° C) | | 83%/17% (guide-limited) |
| 491.175.7.37 | 0.089 $min^{-1}$ (10° C.) | | 5% (guide-limited) |
| 491.185.7.37 | 0.227 $min^{-1}$ (10° C.) | | 44% (guide-limited) |
| 491.186.7.37 | 0.099 $min^{-1}$ (10° C.) | | 11% (guide-limited) |
| 491.196.7.37 | 0.292 $min^{-1}$ (10° C.) | | 46% (guide-limited) |
| 491.214.7.37 | 0.284 $min^{-1}$ (10° C.) | | 30% (guide-limited) |

TABLE 16-continued

Results of cleavage and RNP formation assays

| RNP Construct | $k_{cleave}$* | Initial velocity* | Competent fraction |
|---|---|---|---|
| 491.215.7.37 | 0.398 min$^{-1}$ (10° C.) | | 38% (guide-limited) |
| 515.174.7.37 | 17.10 min$^{-1}$** | | 76% |
| 526.174.7.37 | 19.87 min$^{-1}$** | | 91% |

*Mean and standard deviation
**Rate exceeds resolution of assay

Example 9: Testing Effects of Spacer Length on In Vitro Cleavage Kinetics

Ribonuclear protein complexes (RNP) of two CasX variants and guide RNA with spacers of varying length were tested for in vitro cleavage activity to determine what spacer length supports the most efficient cleavage of a target nucleic acid and whether spacer length preference changes with the protein.

Methods:

Ribonuclear protein complexes (RNP) of CasX and guide RNA with spacers of varying length were tested for in vitro cleavage activity to determine what spacer length supports the most efficient cleavage of a target nucleic acid.

CasX variant 515 and 526 were purified as described above. Guides with scaffold 174 (SEQ ID NO: 2238) were prepared by in vitro transcription (IVT). IVT templates were generated by PCR using Q5 polymerase (NEB M0491) according to the recommended protocol, template oligos for each scaffold backbone, and amplification primers with the T7 promoter and the 7.37 spacer (GGCCGAGATGTCTCGCTCCG (SEQ ID NO: 1084); targeting tdTomato) of 20 nucleotides or truncated from the 3' end to 18 or 19 nucleotides. Spacer sequences as well as the oligonucleotides used to generate each template are shown in Table 17. The resulting templates were then used with T7 RNA polymerase to produce RNA guides according to standard protocols. The guides were purified using denaturing polyacrylamide gel electrophoresis and refolded prior to use.

CasX RNPs were reconstituted by diluting CasX to 1 µM in 1× cleavage buffer (20 mM Tris HCl pH 7.5, 150 mM NaCl, 1 mM TCEP, 5% glycerol, 10 mM MgCl$_2$) and adding sgRNA to 1.2 µM and incubating at 37° C. for 10 mM before being moved to ice until ready to use. Fluorescently-labeled 7.37 target DNA was purchased as individual oligonucleotides from Integrated DNA Technologies (sequences in Table 17), and dsDNA target was prepared by heating an equimolar mix of the two complementary strands in 1× cleavage buffer and slow-cooling to room temperature.

RNPs were diluted in cleavage buffer to a final concentration of 200 nM and incubated at 10° C. without shaking. Cleavage reactions were initiated by the addition of 7.37 target DNA to a final concentration of 10 nM. Timepoints were taken at 0.25, 0.5, 1, 2, 5, 10, and 30 minutes. Timepoints were quenched by adding to an equal volume of 95% formamide, 20 mM EDTA. Samples were denatured by heating at 95° C. for 10 minutes and run on a 10% urea-PAGE gel. Gels were imaged with an Amersham Typhoon and analyzed with IQTL software. The resulting data were plotted and analyzed using Prism. The cleavage of the non-target strand was fit with a single exponential function to determine the apparent first-order rate constant ($k_{cleave}$)

Figure 12A:
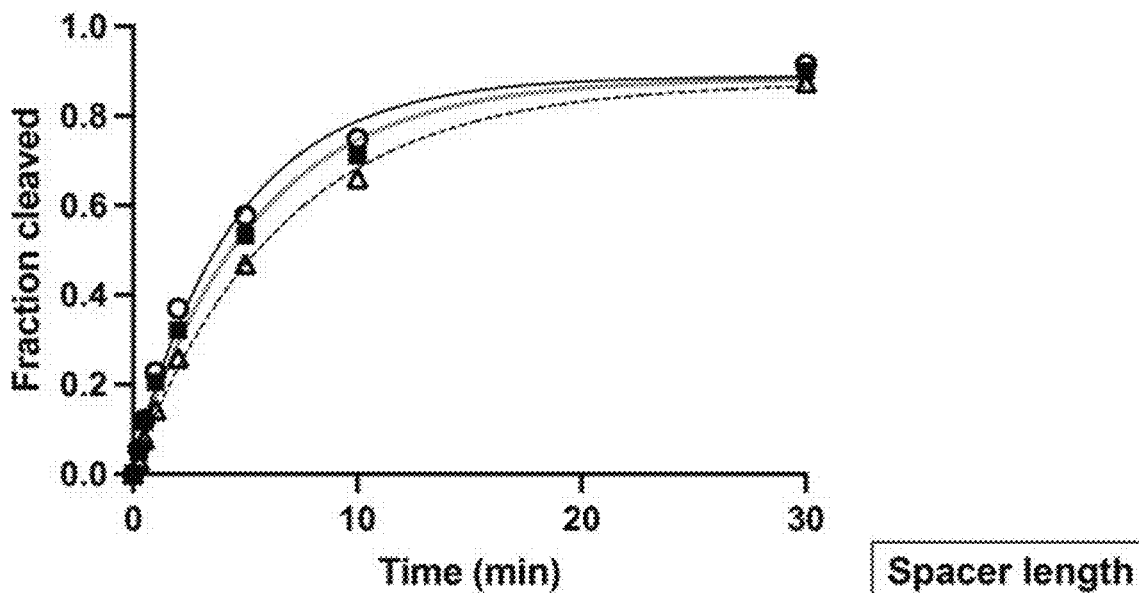
FIG. 12A shows the quantification of cleavage by RNP formed by sgRNA174 and the CasX variants 515 using spacer lengths of 18, 19, or 20 nucleotides, as described in Example 9. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.
Figure 12B:
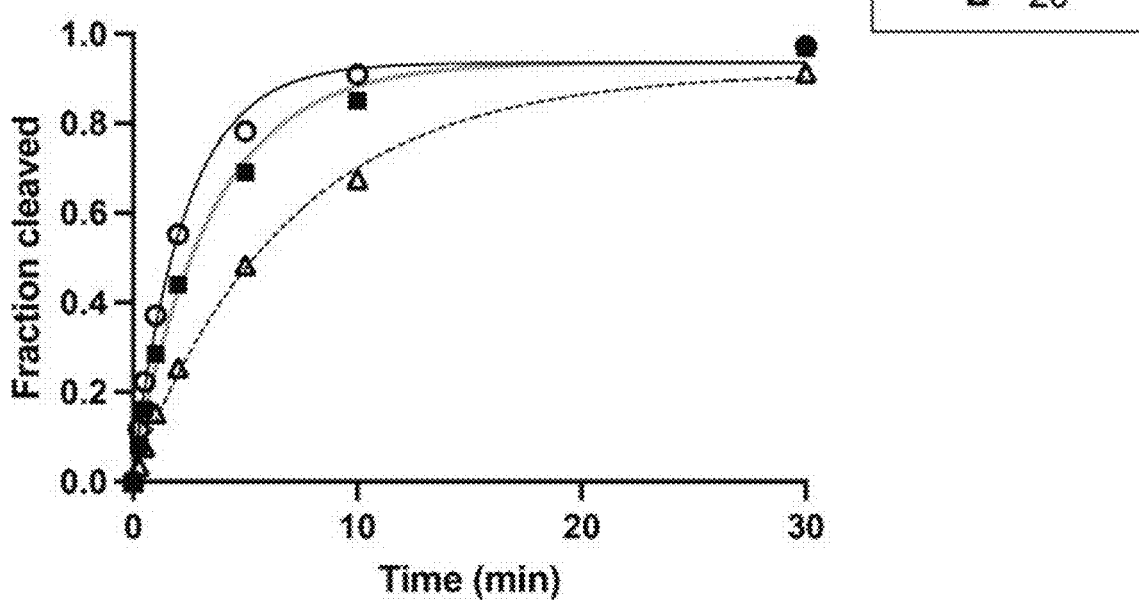
FIG. 12B shows the quantification of cleavage by RNP formed by sgRNA174 and the CasX variant 526 using spacer lengths of 18, 19, or 20 nucleotides, as described in Example 9. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.

Results:

Cleavage rates were compared for CasX variants 515 and 526 in complex with sgRNAs with 18, 19, or 20 nucleotide spacers to determine which spacer length resulted in the most efficient cleavage for each protein variant. Consistent with other experiments performed with in vitro-transcribed sgRNA, the 18-nt spacer guide performed best for both protein variants (FIGS. 12A and B, Table 18). The 18-nt spacer was 1.4-fold faster than the 20-nt spacer for protein 515, and it was 3-fold faster than the 20-nt spacer for protein 526. The 19-nt spacer had intermediate activity for both proteins, though again the difference was more pronounced for variant 526. In general, spacers shorter than 20-nt have been observed to have increased activity across a range of proteins, spacers, and delivery methods, but the degree of improvement and the optimal spacer length have varied. These data show that two engineered proteins that are quite similar in sequence (different in only two residues) can have changes in activity as a result of spacer length that are similar in direction but substantially different in degree.

TABLE 17

Relevant sequences and oligonucleotides

| | |
|---|---|
| 7.37 target sequence non-target strand | IR700-TGAAGCTGACAGCATTCGGGCCGAGATGTCTCGCTCCGTGGCCTTAGCTGTGCTCGCGCT (SEQ ID NO: 1069) |
| 7.37 target sequence target strand | IR800-AGCGCGAGCACAGCTAAGGCCACGGAGCGAGACATCTCGGCCCGAATGCTGTCAGCTTCA (SEQ ID NO: 1068) |
| 20-nt spacer sequence | GGCCGAGATGTCTCGCTCCG (SEQ ID NO: 1085) |
| 18-nt spacer sequence | GGCCGAGATGTCTCGCTC (SEQ ID NO: 1086) |
| 19-nt spacer sequence | GGCCGAGATGTCTCGCTCC (SEQ ID NO: 1087) |
| Scaffold 174 template fwd | GAAATTAATACGACTCACTATAACTGGCGCTTTTATCTGATTACTTTGAGAGCCATCACCAGCGACTATGTCGTAGTGGGTAAAGCT (SEQ ID NO: 1088) |

TABLE 17-continued

Relevant sequences and oligonucleotides

| | |
|---|---|
| Scaffold 174 template rev | CTTTGATGCTCCCTCCGAAGAGGGAGCTTTACCCACTACGA CATAGTCGC (SEQ ID NO: 1089) |
| T7 amplification primer | GAAATTAATACGACTCACTATA (SEQ ID NO: 169) |
| Scaffold 174 20-nt spacer primer | CGGAGCGAGACATCTCGGCCCTTTGATGCTCCCTCC (SEQ ID NO: 1090) |
| Scaffold 174 18-nt spacer primer | GAGCGAGACATCTCGGCCCTTTGATGCTCCCTCC (SEQ ID NO: 1091) |
| Scaffold 174 19-nt spacer primer | GGAGCGAGACATCTCGGCCCTTTGATGCTCCCTCC (SEQ ID NO: 1092) |

TABLE 18

Cleavage rates of RNPs with truncated spacers

| Spacer length | 515 $k_{cleave}$ (min$^{-1}$) | 526 $k_{cleave}$ (min$^{-1}$) |
|---|---|---|
| 18 | 0.215 | 0.427 |
| 19 | 0.182 | 0.282 |
| 20 | 0.150 | 0.143 |

Example 10: Assessing Binding Affinity to the Guide RNA

Purified wild-type and improved CasX will be incubated with synthetic single-guide RNA containing a 3' Cy7.5 moiety in low-salt buffer containing magnesium chloride as well as heparin to prevent non-specific binding and aggregation. The sgRNA will be maintained at a concentration of 10 pM, while the protein will be titrated from 1 pM to 100 µM in separate binding reactions. After allowing the reaction to come to equilibrium, the samples will be run through a vacuum manifold filter-binding assay with a nitrocellulose membrane and a positively charged nylon membrane, which bind protein and nucleic acid, respectively. The membranes will be imaged to identify guide RNA, and the fraction of bound vs unbound RNA will be determined by the amount of fluorescence on the nitrocellulose vs nylon membrane for each protein concentration to calculate the dissociation constant of the protein-sgRNA complex. The experiment will also be carried out with improved variants of the sgRNA to determine if these mutations also affect the affinity of the guide for the wild-type and mutant proteins. We will also perform electromobility shift assays to qualitatively compare to the filter-binding assay and confirm that soluble binding, rather than aggregation, is the primary contributor to protein-RNA association.

Example 11: Assessing Binding Affinity to the Target DNA

Purified wild-type and improved CasX will be complexed with single-guide RNA bearing a targeting sequence complementary to the target nucleic acid. The RNP complex will be incubated with double-stranded target DNA containing a PAM and the appropriate target nucleic acid sequence with a 5' Cy7.5 label on the target strand in low-salt buffer containing magnesium chloride as well as heparin to prevent non-specific binding and aggregation. The target DNA will be maintained at a concentration of 1 nM, while the RNP will be titrated from 1 pM to 100 µM in separate binding reactions. After allowing the reaction to come to equilibrium, the samples will be run on a native 5% polyacrylamide gel to separate bound and unbound target DNA. The gel will be imaged to identify mobility shifts of the target DNA, and the fraction of bound vs unbound DNA will be calculated for each protein concentration to determine the dissociation constant of the RNP-target DNA ternary complex. The experiments are expected to demonstrate the improved binding affinity of the RNP comprising a CasX variant and gRNA variant compared to an RNP comprising a reference CasX and reference gRNA.

Example 12: Assessing Improved Expression and Solubility Characteristics of CasX Variants for RNP Production Wild-type and modified CasX variants will be expressed in BL21 (DE3) E. coli under identical conditions. All proteins will be under the control of an IPTG-inducible T7 promoter. Cells will be grown to an OD of 0.6 in TB media at 37° C., at which point the growth temperature will be reduced to 16° C. and expression will be induced by the addition of 0.5 mM IPTG. Cells will be harvested following 18 hours of expression. Soluble protein fractions will be extracted and analyzed on an SDS-PAGE gel. The relative levels of soluble CasX expression will be identified by Coomassie staining. The proteins will be purified in parallel according to the protocol above, and final yields of pure protein will be compared. To determine the solubility of the purified protein, the constructs will be concentrated in storage buffer until the protein begins to precipitate. Precipitated protein will be removed by centrifugation and the final concentration of soluble protein will be measured to determine the maximum solubility for each variant. Finally, the CasX variants will be complexed with single guide RNA and concentrated until precipitation begins. Precipitated RNP will be removed by centrifugation and the final concentration of soluble RNP will be measured to determine the maximum solubility of each variant when bound to guide RNA.

Example 13: Guide RNA Guide Scaffold Platform Evolution

Experiments were conducted to identify guide RNA guide scaffold variants that exhibit improved activity for double-stranded DNA (dsDNA) cleavage. In order to accomplish this, a large-scale library of scaffold variants was designed and tested in a pooled manner for functional knockout of a reporter gene in human cells. Scaffold variants leading to improved knockout were determined by sequencing the functional elements within the pool and subsequent computational analysis.

Materials and Methods

Library Design

Assessment of RNA Secondary Structure Stability

RNAfold (v2.4.14) (Lorenz R, et al. ViennaRNA Package 2.0. Algorithms Mol Biol. 6:26 (2011)) was used to predict the secondary structure stability of RNA sequences, similar to what was done in Jarmoskaite I., et al. A quantitative and predictive model for RNA binding by human pumilio proteins. Mol Cell. 74(5):966 (2019). To assess the $\Delta\Delta G\_BC$ value, the ensemble free energy ($\Delta G$) of the unconstrained ensemble was calculated, then the ensemble free energy ($\Delta G$) of the constrained ensemble was calculated. The $\Delta\Delta G\_BC$ is the difference between the constrained and unconstrained $\Delta G$ values. A constraint string was used that reflects the base-pairing of the pseudoknot stem, scaffold stem, and extended stem, and requires the bases of the triplex to be unpaired.

Calculation of Pseudoknot Stem Secondary Structure Stability

Pseudoknot structure stability was calculated for the entire stem-loop spanning positions 3-33, using the triplex loop sequence from guide scaffold 175. Further, a constraint string was generated that enforced pairing of the pseudoknot bases and unpairing of the bases in the triplex loop. Changes in stability could thus only be due to the differences in the sequence of the pseudoknot stem. For example, the pseudoknot sequence AAAACG_CGTTTT was turned into a stem-loop sequence by inserting the triplex loop sequence CUUUAUCUCAUUACUUUGA (SEQ ID NO: 158), so that the final sequence would be AAAACGCUUUAUCUCAUUACUUUGACGTTTT (SEQ ID NO: 159), and the constraint string was: '(((((((xxxxxxxxxxxxxxxxxxx)))))))' (SEQ ID NO: 160, where x=n).

Molecular Biology

Molecular Biology of Library Construction

The designed library of guide RNA scaffold variants was synthesized and obtained from Twist Biosciences, then amplified by PCR with primers specific to the library. These primers amplify additional sequence at the 5' and 3' ends of the library to introduce sequence recognition sites for the restriction enzyme SapI. PCR was performed with Q5 DNA Polymerase (New England Biolabs) and performed according to the manufacturer's instructions. Typical PCR conditions were: 10 ng of template library DNA, 1×Q5 DNA Polymerase Buffer, 300 nM dNTPs, 300 nM each primer, 0.25 µl of Q5 DNA Polymerase in a 50 µl reaction. On a thermal cycler a typical program would be: cycle for 95° C. for 5 min; then 20 cycles of 98° C. for 15 s, 65° C. for 20 s, 72° C. for 1 min; with a final extension of 2 min at 72° C. Amplified DNA product was purified with DNA Clean and Concentrator kit (Zymo Research). This PCR amplicon, as well as plasmid pKB4, was then digested with the restriction enzyme SapI (New England Biolabs) and both were independently gel purified by agarose gel electrophoresis followed by gel extraction (Zymo) according to the manufacturer's instructions. Libraries were then ligated using T4 DNA Ligase (New England Biolabs), purified with DNA Clean and Concentrator kit (Zymo), and transformed into MegaX DH10B T1R Electrocomp Cells (ThermoFisher Scientific) all according to the manufacturer's instructions. Transformed libraries were recovered for one hour in SOC media, then grown overnight at 37° C. with shaking in 5 mL of 2xyt media. Plasmid DNA was then miniprepped from the cultures (QIAGEN). Plasmid DNA was then further cloned by digestion with restriction enzyme Esp3I (New England Biolabs), followed by ligation with annealed oligonucleotides possessing complementary single stranded DNA overhangs and the desired spacer sequence for targeting GFP. The oligonucleotides possessed 5' phosphorylation modifications, and were annealed by heating to 95° C. for 1 min, followed by reduction of the temperature by two degrees per minutes until a final temperature of 25° C. was reached. Ligation was performed as a Golden Gate Assembly Reaction, where typical reaction conditions consisted of 1 µg of pre-digested plasmid library, 1 µM annealed oligonucleotides, 2 µL T4 DNA Ligase, 2 µL Esp3I, and 1×T4 DNA Ligase Buffer in a total volume of 40 µL water. The reaction was cycled 25 times between 37° C. for 3 minutes and 16° C. for 5 minutes. As above, the library was purified, transformed, grown overnight, and miniprepped. The resulting library of plasmids was then used for the production of lentivirus.

Library Screening

LV Production

Lentiviral particles were generated by transfecting LentiX HEK293T cells, seeded 24 h prior, at a confluency of 70-90%. Plasmids containing the pooled library were introduced to a second generation lentiviral system containing the packaging and VSV-G envelope plasmids with polyethylenimine, in serum-free media. For particle production, media is changed 12 hours post-transfection, and viruses harvested at 36-48 h post-transfection. Viral supernatant filtered using 0.45 µm PES membrane filters and diluted in cell culture media when appropriate, prior to addition to target cells.

72 hours post-filtration, aliquots of lentiviral supernatant were titered by TaqMan qPCR. Viral genomic RNA was isolated using a phenol-chloroform extraction (TRIzol), followed by alcohol precipitation. Quality and quantity of extraction was evaluated by nano-drop reading. Any residual plasmid DNA was then digested with DNase I just prior to cDNA production by ThermoFischer SuperScript IV Reverse Transcriptase. Viral cDNA was subject to serial dilutions through 1:1000 and combined with WPRE based primers and TaqMan Master Mix prior to qPCR by Bio-Rad CFX96. All sample dilutions are added in duplicate and averaged prior to titer calculations against a known, plasmid-based standard curve. Water is always measured as a negative control.

LV Screening (Transduction, Maintenance, Gating, Sorting, gDNA Isolation)

Target reporter cells are passed 24-48 h prior to transduction to ensure cellular division occurs. At the point of transduction, the cells were trypsinized, counted, and diluted to appropriate density. Cells were resuspended with no treatment, library- or control-containing neat lentiviral supernatant at a low MOI (0.1-5, by viral genome) to minimize dual lentiviral integrations. The lentiviral-cellular mixtures were seeded at 40-60% confluency prior to incubation at 37° C., 5% $CO_2$. Cells were selected for successful transduction 48 h post-transduction with puromycin at 1-3 µg/ml for 4-6 days followed by recovery in HEK or Fb medium.

Post-selection, cells were suspended in 4',6-diamidino-2-phenylindole (DAPI) and phosphate-buffered saline (PBS). Cells were then filtered by Corning strainer-cap FACS tube (Prod. 352235) and sorted on the Sony MA900. Cells were sorted for knockdown of the fluorescent reporter, in addition to gating for single, live cells via standard methods. Sorted cells from the experiment were lysed, and the genome was extracted using a Zymo Quick-DNA Miniprep Plus following the manufacturer's protocol.

Processing for Next Generation Sequencing (NGS)

Genomic DNA was amplified via PCR with primers specific to the guide RNA-encoding DNA, to form a target amplicon. These primers contain additional sequence at the 5' ends to introduce Illumina read and 2 sequences. Typical PCR conditions would be: 2 µg of gDNA, 1× Kapa Hifi buffer, 300 nM dNTPs, 300 nM each primer, 0.75 µl of Kapa Hifi Hotstart DNA polymerase in a 50 µl reaction. On a thermal cycler, cycle for 95° C. for 5 min; then 15 cycles of 98° C. for 15 s, 62° C. for 20 s, 72° C. for 1 min; with a final extension of 2 min at 72° C. Amplified DNA product is purified with Ampure XP DNA cleanup kit. A second PCR step was done with indexing adapters to allow multiplexing on the Illumina platform. 20 µl of the purified product from the previous step was combined with 1× Kapa GC buffer, 300 nM dNTPs, 200 nM each primer, 0.75 µl of Kapa Hifi Hotstart DNA polymerase in a 50 µl reaction. On a thermal cycler, cycle for 95° C. for 5 min; then 5-16 cycles of 98° C. for 15 s, 65° C. for 15 s, 72° C. for 30 s; with a final extension of 2 min at 72° C. Amplified DNA product is purified with Ampure XP DNA cleanup kit. Quality and quantification of the amplicon was assessed using a Fragment Analyzer DNA analyzer kit (Agilent, dsDNA 35-1500 bp) Amplicons were sequenced on the Illumina Miseg™ (v3, 150 cycles of single-end sequencing) according to the manufacturer's instructions.

NGS Analysis (Sample Processing and Data Analysis)

Reads were trimmed for adapter sequences with cutadapt (version 2.1), and the guide sequence (comprising the scaffold sequence and spacer sequence) was extracted for each read (also using cutadapt v 2.1 linked adapters to extract the sequence between the upstream and downstream amplicon sequence). Unique guide RNA sequences were counted, and then each scaffold sequence was compared to the list of designed sequences and to the sequence of guide scaffolds 174 (SEQ ID NO: 2238) and 175 (SEQ ID NO: 2239) to determine the identity of each.

Read counts for each unique guide RNA sequence were normalized for sequencing depth using mean normalization. Enrichment was calculated for each sequence by dividing the normalized read count in each GFP-sample by the normalized read count in the associated naive sample. For both selections (R2 and R4), the GFP- and naive populations were processed for NGS on three separate days, forming an enrichment value for each scaffold in triplicate. An overall enrichment score per scaffold was calculated after summing the read counts for the naive and GFP-samples across triplicates.

Two enrichment scores from different selections were combined by a weighted average of the individual $\log_2$ enrichment scores, weighted by their relative representations within the naive population.

Error on the $\log_2$ enrichment scores was estimated calculating a 95% confidence interval on the average enrichment score across triplicate samples. These errors are propagated when combining the enrichment values for the two separate selections.

Results and Discussion

Library Design, Ordering, and Cloning

A library of guide RNA variants was designed to both test variation to the RNA scaffold in an unbiased manner and in a targeted manner that focused on key modules within the RNA scaffold.

In the unbiased portion of the library, all single nucleotide substitutions, insertions, and deletions were designed to each residue of guide scaffolds 174 (SEQ ID NO: 2238) and 175 (SEQ ID NO: 2239) (2800 individual sequences). Double mutants were designed to specifically focus on areas that could possibly be interacting; thus if in the CryoEM structure (PDBid: 6NY2), two residues were involved in a canonical or non-canonical base pairing interaction, or two residues were predicted to pair in the lowest-energy structure predicted by RNAfold (v2.4.14), then the corresponding residues in guide scaffolds 174 and 174 were mutated (including all possible substitutions, insertions, and deletions of both residues). Adjacent residues to these 'interacting' residues were also mutated; however for these only substitutions of each of the two residues were included. In the final library, ~27K sequences were designed with two mutations relative to guide scaffolds 174 or 175.

Figure 18:
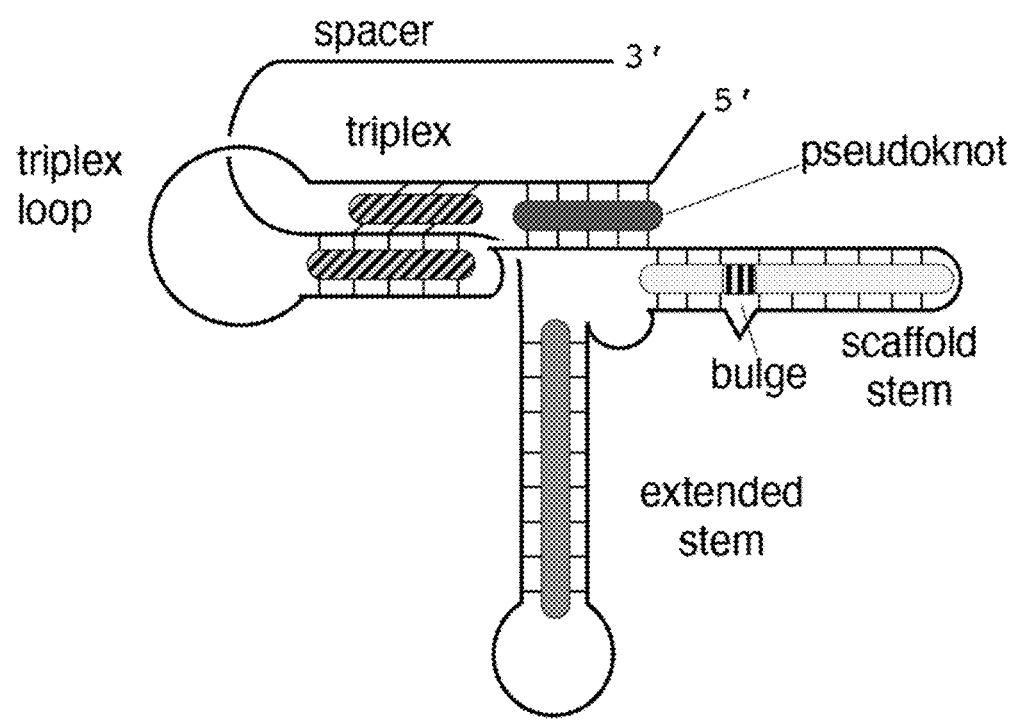
FIG. 18 is a schematic of the regions and domains of a guide RNA used to design a scaffold library, as described in Example 13.
Figure 19:
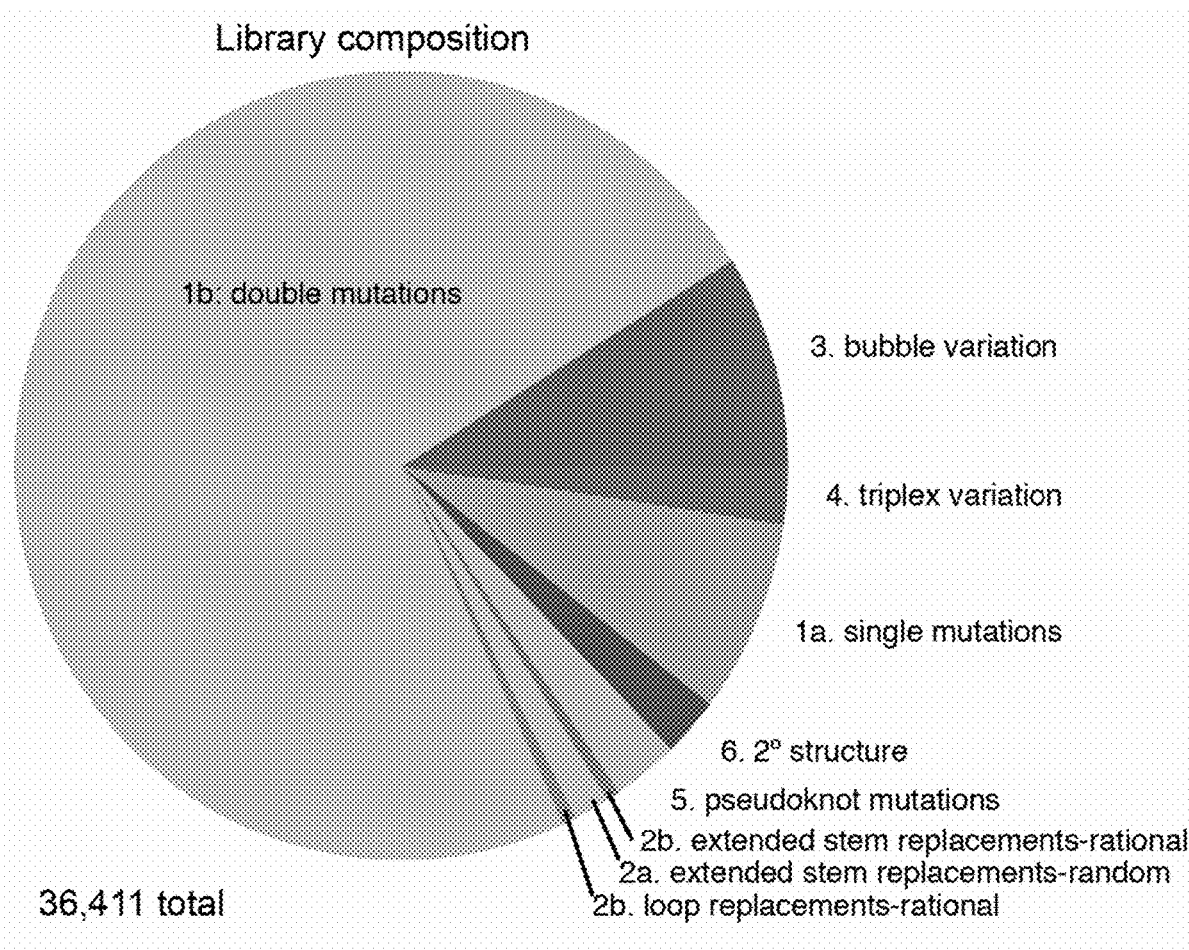
FIG. 19 is a pie chart of the relative distribution and design of the scaffold library with both unbiased (double and single mutations) and targeted mutations (towards the triplex, scaffold stem bubble, pseudoknot, and extended stem and loop) indicated, as described in Example 13.
Figure 20:
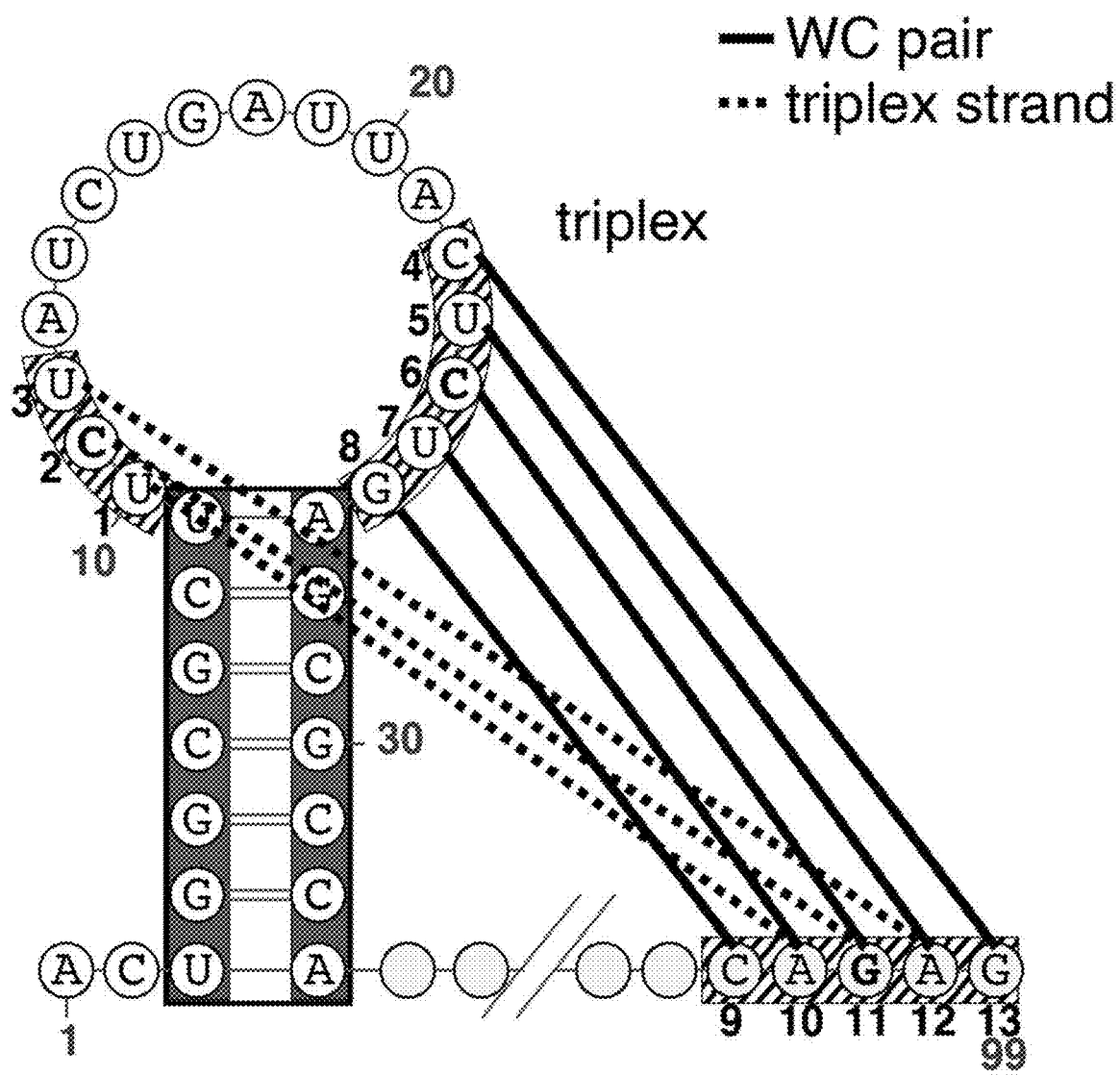

In the portion of the library devoted to specific mutagenesis of key regions of the RNA scaffold, modifications were designed to: the pseudoknot region, the triplex region, the scaffold bubble, and the extended stem (see FIG. 18 for region identification). In each of these targeted sections of the library, the entire domain was mutagenized in a hypothesis-driven manner (FIG. 19). As an example, for the triplex region, each of the base triplets that comprise the triplex was mutagenized to a different triplex-forming motif (see FIG. 20). This type of mutagenesis is distinct from that employed in the scaffold stem bubble, in which all possible substitutions of the bases surrounding the bubble were mutagenized (i.e., with up to 5 mutations relative to guide sequences 174 or 175). In contrast again, the 5 base-pairs comprising the pseudoknot stem were completely replaced with alternate Watson-Crick pairing sequence (up to 10 distinct bases mutagenized).

A final targeted section of the library was meant to optimize for sequences that were more likely to form secondary structures amenable to binding of the protein. In short, the secondary structure stability of a sequence was predicted under two conditions: 1) in the absence of any constraints, 2) constrained such that the key secondary structure elements such as pseudoknot stem, scaffold stem, and extended stem are formed (see Materials and Methods). Our hypothesis was that the difference in stability between these two conditions (called here ΔΔG_BC) would be minimal for sequences that are more amenable to protein binding, and thus we should search for sequences in which this difference is minimal).

The designed library was ordered from Twist (~40K distinct sequences), and synthesized to include golden gate sites for cloning into a lentiviral plasmid backbone that also expressed the protein STX119 (see Materials and Methods). A spacer sequence targeting the GFP gene was cloned into the library vector, effectively creating single-guide RNAs from each RNA scaffold variant to target the GFP gene. The representation of the designed library variants was assessed with next generation sequencing (see Materials and Methods).

Library Screening and Assessment

The plasmid library containing the guide RNA variants and a single CasX protein (version 119) was made into lentiviral particles (see Materials and Methods); particles were titered based on copy number of viral genomes using a qPCR assay (see Materials and Methods). A cell line stably expressing GFP was transduced with the lentiviral particle library at a low multiplicity of infection (MOI) to enforce that each cell integrated at most one library member. The cell pool was selected to retain only cells that had a genomic integration. Finally, the cell population was sorted for GFP expression, and a population of GFP negative cells was obtained. These GFP negative cells contained the library members that effectively targeted the CasX RNP to the GFP protein, causing an indel and subsequent loss of function.

Genomic DNA from the unsorted cell population ("naive") and the GFP negative population was processed to isolate the sequence of the guide RNA library members in each cell. To determine the representation of guide RNAs in the naive and GFP negative populations, next generation sequencing was performed. Enrichment scores were calculated for each library member by dividing the library member's representation in the GFP-population by its representation in the naive population: A high enrichment score indicates a library member that is much more frequent in the active, GFP negative population than in the starting pool, and thus is an active variant capable of effectively generating an indel within the GFP gene (enrichment value >1, $\log_2$ enrichment >0). A low enrichment score indicates a library member that is depleted in the active GFP-population compared to the naive, and thus ineffective at forming an indel (enrichment value <1, $\log_2$ enrichment <0). As a final statistic for comparison, the relative enrichment value was calculated as the enrichment of a library member (in the GFP negative vs naive population), divided by the enrichment of the reference scaffold sequence (in the GFP negative vs naive population). (In log space, these values are simply subtracted.) The enrichment values of the reference scaffold sequences are shown in FIG. 21).

The screen was performed multiple times, with independent production of lentiviral particles, transduction of cells, selection and sorting to obtain naive and GFP negative populations, and sequencing to learn enrichment values of each library member. These screens were called R2 and R4, and largely reproduce the enrichment values obtained for single nucleotide variants on guide scaffolds 174 and 175 (FIG. 22). The screen was able to identify many possible combinations of mutations that were enriched in the functional GFP-population, and thus can lead to functional RNPs. In contrast, no guides that contained non-targeting spacers were enriched, confirming that enrichment is a selective cutoff (data not shown). The full set of mutations on guide scaffolds 174 and 175 that were enriched are given in Tables 19 and 20, respectively. These lists reveal the sequence diversity still capable of achieving targeted, functional RNPs.

Single Nucleotide Mutations Indicate Mutable Regions of the Scaffold:

To determine scaffold mutations that lead to similar or improved activity relative to guide scaffolds 174 and 175, enrichment values of single nucleotide substitutions, insertions, or deletions were plotted (FIG. 23). Generally, single nucleotide changes on 174 were more tolerated than 175, perhaps reflecting higher activity of 174 in this context and thus a higher tolerance to mutations that dampen activity (FIG. 21 and FIG. 24). Single nucleotide mutations on 175 that were favorable were also favorable in the 174 context in the vast majority of cases (FIG. 24), and thus the values for mutations on scaffold 175 were taken to be a more stringent readout of mutation effects. Key mutable areas were revealed by this analysis, as described in the following paragraphs:

The most notable feature was the extended stem, which showed similar enrichment values as the reference sequences 174 or 175, suggesting that the scaffold could tolerate changes in this region, similar to what has been seen in the past and would be predicted by structural analysis of the CasX RNP in which the extended stem is seen to have little contact with the protein.

The triplex loop was another area that showed high enrichment relative to the reference scaffold, especially when made in guide scaffold 175 (e.g., especially mutations to C15 or C17). Notably, the C17 position in 175 is already mutated to a G in scaffold 174, which is one of the two highly enriched mutations at this position to scaffold 175.

Changes to either member of the predicted pair in the pseudoknot stem between G7 and A29 were both highly enriched relative to the reference, especially in guide scaffold 175. This pair is a noncanonical G:A pairing in both guide scaffolds 174 and 175. The most strongly enriched mutation at these positions were in guide scaffold 175, converting A29 to a C or a T; the first of which would form a canonical Watson-Crick pairing (G7:C29), and the second of which would form a GU wobble pair (G7:U29), both of which may be expected to increase stability of the helix relative to the G:A pair. Converting the G7 to a T was also highly enriched, which would form a canonical pair (U7:A29) at this position. Clearly, these positions favor being more stably paired. In general, the 5' end was mutable, with few changes leading to de-enrichment.

Finally, the insertion of a C at position 54 in guide scaffold 175 was highly enriched, whereas deletion of either the A or the inserted G at the analogous position in guide scaffold 174 both had similar enrichment values as the reference. Taken together, the guide scaffold may prefer having two nucleotides in this scaffold stem bubble, but it may not be a strong preference. These results are further examined in the sections below.

Pseudoknot Stem Stability is Integral to Scaffold Activity

To further explore the effect of the pseudoknot stem on scaffold activity, the pseudoknot stem was modified in the following ways: (1) the base pairs within the stem were shuffled, such that each new pseudoknot has the same composition of base pairs, but in a different order within the stem; (2) the base pairs were completely replaced with random, WC-paired sequence. 291 pseudoknot stems were tested. Analysis of the first set of sequences shows a strong preference for the G-A pair to be in the first position of the pseudoknot stem, relative to the other possible positions (2-6; in the wildtype sequence it is in position 5; FIG. 25), while the results demonstrate that having a GA pair at each of the positions 2-6 in the pseudoknot stem is generally unfavorable, with low average enrichment. Having the G-A bases at position 1 likely stabilizes the pseudoknot stem by allowing the rest of the helix to form from stacking, Watson-Crick pairs only. This result further supports that the scaffold prefers a fully-paired pseudoknot stem.

A substantial number of pseudoknot sequences had positive $\log_2$ enrichment, suggesting that replacing this sequence with alternate base pairs was generally tolerated (pseudoknot structure in FIG. 26). To further test the hypothesis that a more stable helix in the pseudoknot stem would result in a more active scaffold, the secondary structure stability of each pseudoknot stem was calculated (Materials and Methods). A strong relationship was observed between pseudoknot stability and enrichment, and thus activity (FIG. 27: more active scaffold have stable pseudoknot stems), with guide scaffolds with stable pseudoknot stems (<−7 kcal/mol) having high enrichment and guide scaffolds with destabilized pseudoknot stems (≥−3 kcal/mol) having very low enrichment.

Double Mutations Indicate Mutable Regions of the Guide Scaffold:

Double mutations to each reference guide scaffold were examined to further identify mutable regions within the scaffold, and potential mutations to improve scaffold activity. Focusing on just a single pair of positions—positions 7 and 29 which are predicted to form a noncanonical G:A pair in the pseudoknot stem and supports mutagenesis (see sections above)—we can plot all 64 double mutations for this pair of positions (FIG. 28). Canonical pairs are favored at these two positions (e.g. substitution of a C at position 7 and a G at position 29 creates a G:C pair and is enriched; substitution of a C at position 7 and an insertion of a G at position 29 similarly creates a G:C pair, substitution of an A at position 7 and a U at position 29 creates an A:U pair). No pair of insertions was enriched, perhaps because inserting a canonical pair here is not sufficient to stabilize the helix given that the G:A pair is shifted up a position in the helix and not removed entirely. Surprisingly, several enriched double mutations did not form canonical pairs; e.g. substitutions of U at position 7 and C at position 29 (which forms a noncanonical U:C pair), substitutions of U at position 7 and U at position 29 (forming a U:U pair), as well as a few others (FIG. 28). It is possible that a purine:purine pair is substantially more disruptive to the helix than other noncanonical pairs. Indeed, substitution of an A at position 7 and G at position 29 again forms an A:G pair, which is not enriched at this position.

Enrichment values of double substitutions within each of the key structural elements of guide scaffold 175 were determined from heat maps in which each position could have up to three substitutions. It was determined that the scaffold stem was the least tolerant to mutation, suggesting a tightly constrained sequence in this region.

The results demonstrate substantial changes may be made to the guide scaffold that can still result in functional gene knockout when utilized in an editing assay. In particular, the results demonstrate key positions that may be utilized to improve activity through modifications in the guide scaffold, including increased secondary structure stability of the pseudoknot stem within the scaffold.

TABLE 19

Guide 174 mutations and resulting relative enrichment

| Log$_2$ enrichment | Mutations on gRNA scaffold 174* (SEQ ID NO: 2238) |
|---|---|
| 3.25 to 3.5 | G79A, A80G; T34A, G78T; G7T, G75A; G78A, A80T; ˆC2, A33T; ˆA1, C68T; TG3CT, CGC6TAG, GAG28CTA, CA32AG; TG3CA, GC7AA, GA28TT, CA32TG; ˆC4, C6G, T12__, G17C, GAG28CCC, C32G, A80C; T9C, T14A, T71A, C73A; C70A, G77T |
| 3.0 to 3.25 | A29T, G78T; T9C, G17C, A27T, G79__; C2G, A21G; ˆA81, ˆC81; T71A, C73A; T14C, T16G; ˆT64, ˆG81; T9C, G17C, ˆTG65; C2G, T16A; G7C, TC14AT, G17A, T34A; G75A, G77A; G7C, A21T; T-.3.CA, GC.7.-T, G28__, -.A.33.TG, ˆT84; T65C, C82T; GCTCCC63__, ˆAATGAAAA70, ˆTTTTCATT76, GGGAGC77__; ˆC2, G7A, A27T; T9C, G17C, C67G; ˆA78, ˆT78; T3C, GCG5AGA, AGC29GCT, A33G; T9C, G17C, G78C; T3C, GC5TG, AGC29CAA, A33G; T9A, ˆT68, G77A; G7A, T9G; T65A, ˆG77; ˆG70, ˆC75; C2T, G79C; ˆC66, G78A; A29C, G75A; C15A, A60G; C67G, ˆA78; T14C, G17T, G40A, A76G; T34A, CT64TC; ˆA69, T69A; T45G, G79T; T69C, ˆC76; C2A, G54C; A13C, C15A, G74C; C70G, ˆA75; A76G, G77C; C67T, G78C; TG3CC, A29C, CA32GG; ˆT7, A29C; C2A, T34A; ˆA66, ˆA66; C66T, A80C; ˆG17; ˆC76, ˆA76; A29C; C15G, C67G, T72G; ˆT70, ˆA70; C15G, T16G; C64T, C66A; T69G, G74C; ˆA3, G74C; ˆT65, ˆT80 |
| 2.9 to 3.0 | A29C, A33T; C64T, G78A; ˆC64, A80T; ˆA74; T65A, ˆA80; ˆT69, G75T; ˆC79, ˆA79; A29G, T59A; T69G, G75C, G78A; ˆG70, ˆA70; G7A, TC14CG, G17A, C64T; ˆT69, ˆA76; T9C, G17C, C68T, T72C; ˆT69, A76G; A33T, C66G; C66T, C67G; TTC71ACA, ˆGGATGT75; A13G, T14A; T69A, G74C; G74T, A76G; G77C, G78A; A27C, T84G; C2__, C66G; T71C, G75C; TC14AG, G78A; T3G, A33T; T9C, G28A; ˆA1, C2T; C68T, T72C; TGGC3CCAG, C8A, GA26__, --A.33.TGG; C64T, C66G; ˆA67, C67G; C68T, G74A, G77C; G7T; C2T, G78T; C68__, G77T; T25C, A29C; ˆA78, G78A; ˆC78, G78C; G7C, A60G; T34A, T45A; T3__, G7A, ˆA9, ˆT28, A29G, A33__; ˆCAG70, T72G, G--.74.AGT; A27G, A29C; T9C, G17C, T47C; ˆT19; ˆA65, ˆT65; C67G, C68T |
| 2.8 to 2.9 | T3C, G5T, C8G, GA28CC, CCA31AAG; T69C, A76G; C66T, A80T; ˆG13; C2__, T65G; G7C, T9G; T9C, G17C, TT71AC; C6G, A29T; ˆC66, ˆC79; C70A, A76T; T3A, CG6AC, AG29GT, A33G; ˆT7, T12__; ˆT69, ˆA76, A88C; C35G, G58C; ˆA79, ˆT79; T16__, C67T, G79__; G7T, T9A; A29T, C37T, C66G, ˆG77; C2__, G81A; C15G, T34G; T3__, ˆT9, ˆC28, A29C, C32__; ˆT76, ˆA76; G7C, A27T; C2__, G79C; TGGC3ACAG, GA26__, --A.33.TGT; ˆG65, ˆG77; ˆAC1, GC5__, C8T, GA26__, G30A, ˆGT34; T9C, G17C, C66T, A80T; T71G, T72G; G4C, CT8GC, G17C, GA28AC, C32G, T69C, G75C; C41A, G51T; ˆT78; T9C, G17C, T65A, A80C; AG29CA, C82G; T9G, C82T; T45A, T47C; C2T, T3A; T65A, A80G; C2G, G4A, C32T; G7C, T59G; T9C, T14G; C2G, A29C, T52A; T9C, G17C, -.A.53.CC; T9C, T69__, A76__; C68A, G75C; A1G, A33T; T3__, ˆT9, G28__, ˆG32; ˆG70, G75C; ˆC54, G54C; ˆT79, G79A; G17C, C70T, A76G; G77A; ˆT69, A76C; T65A, ˆC80; ˆA66, G79__; T9G, ˆG85; ˆTGGAAGAT63, C---.66.TCGG, C68A, GGAGGGAG74__, ˆA83; ˆT2; G7A, A29C; ˆA69, ˆC76; C6A, A29C; C2__, T9C, G17C, GA79TG |
| 2.7 to 2.8 | T34A, ˆT37; A36T, T65C; C2__, T69G; C73A, G74C; G17__; ˆG65, ˆA65; ˆT67, C67T; C2G, A29T; T9C, G17C, ˆC66, ˆG74; C70A, T71C; T14A, C15T; G4C, C32G, G78C; T9C, G17C, T34A; ˆA66, ˆC79; AGT53GTG; G79__; T9G, T14A; ˆC64, ˆC80; T65C, ˆG66; ˆGT1, G7A, T9C; A60T, G78T; T9C, G17C, C67A, G79A; TC65CG, A80G; T14C, T16C; T3__; ˆCGAAC70, T71A, G74C; G7T, C8G; T3A, GC7CG, GA28CG, A33T; C66T, G78T; A1G, T9C, G17C; T69C, C70A; C70T, T72G; T69C, T71G, A80T; T16G, A29C; T11G, A29C; G17A, ˆTA75, A88C; G7T, G40A, A61G; ˆAC81, A88C; ˆA71; |

TABLE 19-continued

Guide 174 mutations and resulting relative enrichment

| Log₂ enrichment | Mutations on gRNA scaffold 174* (SEQ ID NO: 2238) |
|---|---|
| | G5C, C8G, GA28AC, C31G, C73T; G74T, A76C; ˜T68, ˆA76; C2_, C70A; |
| | T9C, G28T; G28T, A29C; ˜C29; A29C, GA75AC; ˜T52, G54C; G7A, T9C, G17C; |
| | T9C, G17C, G79A; --A.29.CAC; ˆA68, G77A; ˜T69; G7C, T9C; A80C, C82T; |
| | ˜C75, G75T; T14A, A29C; T72C, C73A; T9C, G17C, C66A, G79_; C2_, A33T; |
| | ˜T2, C64T; ˆAT79, A88C; C66G, A80C; ˆA67, ˜T78; ˜G67, G78A; ˆA76; |
| | A21G, ˜C66, ˜T77; C2A, A36G, T69A; G63T, T71C; T9C, G17C, -G.77.CT; |
| | ˜T2, T34A; C68T, ˜C77; T9C, G17C, T72C; T69A, C70T; CT15TA, A18T; |
| | TGG3ACA, C8G, GA28CC, CCA31TGT; T9C, A29C; C6G, G30C; -T.3.AA, C67G; |
| | C73_; ˜G68, ˆA76; T69C, ˆA76; A80G; T69C, A76_; ˜G68, ˜T77 |
| 2.6 to 2.7 | T9A, A29C; A76G; T9C, G17C, AG76CC; T9C, ˆA13; ˆA67, ˜T78, A88C; |
| | C70A, T72A; C66G, ˜T79; ˜T64, C64T; ˆA70, C70G; ˜G65, A80C; |
| | T9C, G17C, C66T, G78C; C2_, T9G; T69_, A76T; T3A, G7A, A29T, A33G; |
| | T45G, C68A; ˜T65, ˜T80, A88C; C66G; C64T, T71G; C2G, G54T; A1G, T3A; |
| | ˜G70, G75T; T65A, ˜T80; -T.3.AC, GC.7.A-, |
| | GAG28TGC, CA32GG, T72A, ˜G74, A76G; A21C; T69G, ˆA76; C68G, C70A; |
| | C67T, A80T; ˆA70, ˜C75; T9A, T14C; T3A, CGC6TCT, GAG28AGA, A33T; |
| | G54_; C68T; ˜T65, G79C; C2_; C67G, G79T; CT2TG, G7A, G77C; T71G, G74A; |
| | C66T, G81A; A29T; --A.29.CAT, A88C; T69_, ˜C76; T9C, G17C, ˜G68; |
| | ˆA69, T69C; A29C, G30T; T69_; G17C; ˆA67, G78C; T65A; ˜G79, ˜T79; |
| | A76G, G77T; ˜GC1, A88C; A27T, A29C; ˜CA79, A88C; T69_, G75T; |
| | C38G, ˜C56, G77A; C68T, G77C; A29C, AG39GT, T52C; G79T, A80T; |
| | G7T, A61T; T16C; ˆA13; G7C, C15G; G5C, C8G, GA28AC, C31G; C2_, G77C; |
| | A29C, T52A; G75C, A76G; T9C, G17C, ˜C76; C8G, A29C; |
| | TGG3GTC, C8G, GA28AC, CCA31GAC; |
| | C64_, ˜GTG67, C68A, G77T, ˜CAC79, G81_; ˜T68, G79_; ˆA70, C70A; |
| | T65A, AG76GA; ˜C70, ˜C70; C68G, G77T; C6T, A29T; ˜T81; ˜G67, ˆA67; |
| | TGG3GCA, C8A, A29C, CCA31TGC; G7A, A27C, A29G, A80G; G78A; |
| | T52G, G54C; T9C, G17C, T65A, C67T; A1C, ˜C64, ˜T81; ˜T80, A80C; |
| | C67A, C73T; C73T, A80C; C67A, T69C; G7A, A76T, A80G; C2_, C15G; |
| | T69C, G77T; CT2_, G79T; G7C, ˜G28; ˜C79; ˆA80; ˜G1, ˜C1; ˜G65, A80T; |
| | G7T, A29_; -T.3.AC, GC.7.A-, GAG28TGC, CA32GG, T65A; |
| | T9C, ˜T14, G17C, ˜C29; A29T, T69C; T9C, A29G; C64T, T65C; |
| | ˜TG70, T71A, C73_, G75T; T65G, C66T; T59C, ˜C66; T72A, G74A; C2T, T72C; |
| | T71C, A76G; T65G, A80T; TG3_, ˜TG7, GA26_, ˆAG33 |
| 2.5 to 2.6 | T9C, G17C, ˜G81; --A.29.CAT; C68T, A76G; A29C, G79A; G17C, C67G, C70T; |
| | ˜G66, C66G; A29T, G63A, C66A; G28C, A29C; T3G, C67A; T69C, T71C; |
| | T3A, GC7CA, GA28TG, A33G; C70G, G74A; ˜C2, G4C, C8_, ˜CGC28, CCA31_; |
| | C2_, C68T; C66A, A80T; T3A, G5C, GC7AA, GA28TT, C31G, A33T; |
| | T9C, G17C, T72G; T9C, G17C, A29C; ˜C70, G75T; C66T; C66T, G78A; |
| | A36T, G54C, C68T; ˜G9, A29T; A76C; T69C, G77C; ˆA77, ˜G77; T71G, G74C; |
| | C67T, C73G; T71G, AG76GA; ˜C64, T65C; T3G, C68A; G74C; C67T, T69A; |
| | ˆA69; ˆA66, C66T; T71C; T14G, T16C; T9C, G79T; T65C; ˜C15, G17C; |
| | ˜T65, ˜C79; C70G, T71G; G74C, G75T; C2_, C68G; G7T, A27G; ˜CA76, A88C; |
| | ˜T65, ˆA65; T9C, G17C, T45A; A18C, ˆA66; A80C; G7C, TC14CT, G17A; |
| | TG3GC, G7A, A29T, CA32GC; T16G, A29C, G63T, T71C; C2A, G54T, T71C; |
| | ˜T8, A29C; T9C, TG16GC; C70T, G77T; G75T, A76G; T69A; T16A, A18G; |
| | G77A, G78C; A1_, T59C; T14G, T16G; ˆA60, G81A; A29G, A83G; |
| | T34A, GA79TC; T69C, G75A; G7T, T59A; G7T, C82G; A36T, G81T; C2_, G81T; |
| | T14C, T72_; --A.29.CAC, A88C; TGG3_, ˆAAG9, GA28CT, C31G, A33G; |
| | G17C, A18G; C66G, G77A; ˜C5, C6T, C8_, G28C, GC30CG; C82T; G54A, ˜G56; |
| | C2_, C66T; G17C, A18C; G17C, G54_; G28A, T65C; C6T, A29C; G7A, T9C, ˜T79; |
| | T9C, GA17CT; G74A, G75T; C68A, C70G; G42C, C50G; ˜C70, ˜C75; ˜T66, ˜C66; |
| | T3C, CGC6CGCT, G28_, ˆA32, A33G; C73A, G74A; |
| | TG3AC, C6A, AG29CT, CA32GG; C67A, G79A; A76_; C73G, G74T; |
| | TG3CA, GC7AG, GA28CG, CA32TG; T9C, T14C, T71A, C73A; G81C; |
| | A1G, T16A; T69A, ˜G74; C68_; C2A, A60C; T9C, G54T; T14C, C15G; |
| | ˜G66, ˜G66; T16C, A18G; ˆG68, G77C; A29T, -G.78.CC; G7T, ˜T61; CT2_, T72G; |
| | A1G; T65C, C66A; G7C, T34A; ˜C35, T59G; ˆAG77, A88C; ˜TG67, A88C; |
| 2.4 to 2.5 | G54C, T59A; T69G, G75C; C68A, A76G; ˆAT65, A88C; C68T, G77T; G7T, A29C; |
| | T65A, T71A, G74A; T16A; ˜C65, ˆA65; ˜T67, G79_; ˜G71; ˜C18; ˜C29, A29T; |
| | G79A; T69G, T71A; T71C, T72C; C2_, T3_; ˜T67, G78T; |
| | CTCCCTCT64_, C73G, AGG76TTC, ˜TCCCA82; T65A, A83G; C70A, G74A; |
| | G7C, TC14AT, G17A, T34C; G7T, A33C, A36C, A76G; T-.3.CA, GC.7.A-, |
| | AG29GC, CA32TG; C2_, A80G; -T.3.AC, C6T, C8_, G28C, G30C, CA32GT; |
| | G7C, A83G; C2_, C67A; T3G, A29C, T34G, G77A; C2G, A21G, T65C; |
| | G40A, T59A; ˆA66, ˜G66; G81A; C2_, A29G; ˜T64, G81A; |
| | ˜CGC2, CGC6_, GAG28_, ˆAGG33; ˜C77; T69A, A76G; ˜T78, ˜T78; C66A, ˜C79; |
| | C2_, G7A, T34A; T3C, C6T, G30A, A33G, ˜C55; GC7CG, GA28AG; |
| | T3C, G5C, GC7TA, G28T, C31G, A33G; ˜T68, ˜C77; ˜T77, G77A, A27G, ˜GT77; |
| | ˜G66, ˜T79, A88C; T9C, ˜G69, ˆA76; C68T, G75C; ˜T81, ˜T81; ˜C66; T9C, G28C; |
| | T14A, A29C, C66T; ˆA65; T3A, G5C, C8A, A29C, C31G, A33T; CT2_, T71A; |
| | G7C, C15G, A33T; G77A, ˜T78; G63T, C82A; G7A, C15G, G54A, A60C, G79T; |
| | ˆA13, ˜G13; T72G, C73T; A36C, G54T; T3G, G7T; ˜G65, T65C; T65G, C66G; |
| | G77C; T45G; C15A; C41T, G51A; T14A, C2T, G54T; A76T; T71A, A76G; |
| | ˜G66, ˜T79; ˆA7, A29C; TGG3AAC, C8G, GA28CC, CCA31GTG; ˆA1; ˜T29; |

TABLE 19-continued

Guide 174 mutations and resulting relative enrichment

| Log₂ enrichment | Mutations on gRNA scaffold 174* (SEQ ID NO: 2238) |
|---|---|
| | T71G, G74T; T45A; ^AT78, A88C; ^A3, GG4CC, C8_, GA28CG, CCA31GAT; C66T, C70G; C2_, ^A66, ˜C79; ˜TA76, A88C; TG3GA, CG6GA, AG29TC, CA32TC; ˜C80, A80G; G79C; C67G, ˜G77; ˜C66, G79A; G7A, T16C, ˜T68; G7C, T9C, G17C, G75C; C2_, ˜T58; ^A65, ˜C80; A1G, -C.68.GA; G17C, T65G; TG3CC, C6T, C8G, GAG28ACA, CA32GG; T72C, G75A; C64G, A80T; G7A, C66T, C66G, ˜C79; C15A, G17A; ^AG66, A88C; A36_; G79T; T9C, G17C, ˜T58; T10G, A29T; ˜G69, ˜C76; ^A69, A76_; G7A, A29G; A53_; T65G, ^A80; C70A, C73A; T59C, G74T; C67A; G54T, ˜G56; ˜G66; C2_, A29C; C38_, G54_; T3_, C6T, ˜C8, ˜G28, G30A, A33_; -TG.3.ACC, C6A, C8_, ˜CTC28, A29G, CCA31_; T9C, T14A; C64_; T14G, G54A; T71C, C73G, A83C; T9C, G17C; A53G, G54T; C66A, A80G; ˜G63, ˜G81; ˜G1; ˜C78, ˜C78 |
| 2.3 to 2.4 | G7A, T9C; ˜T67, ˜G67; C2_, C67T; A80_; ˜G1, A13C; ˜G66, G79C; T69A, A76T; T9C, T14C; A76G, G78C; T16G, G17T; T69C, G77A; T65_, A80G; G7C, T14C, T34G; C66T, C67T; A53G, -A.80.TC; C67T, G77C; C73A, G74T; A36G, C68G; T9C, G17C, ˜C78; TGG3GCT, C8G, ^AC28, CA32_; ˜T18; ˜C29, ˜T29; ˜GGGCG63, C68T, TTCGGA71_, ˜CCGCC82; T9C, G17C, C66T, A80G; ^A67, ˜G67; C2_, G79T; T3A, CGC6GAT, GAG28ATC, A33T; C2_, A21G, G79C; C2_, A21G; C64T, G77A; C8A, G79C; C67G, ^A78, A80C; T69C, ^A70; G74T, G75C; ˜T76, A76G; A76T, A80G; ˜C64; ˜C29, C50T; ^AGCTTA65, ^ATTG68, T69A, T72C, G77T, GA--.79.AGCT; A29G, G30A; T65C, A80C; ˜C76, ˜T76; T9C; ˜G67, G79_; C68T, G79T; ˜CTCA3, GCGC5_, ˜CAT28, CCA31_; ˜GA70, A88C; -T.3.AC, GC.7.A-, GAG28TGC, CA32GG; A21G; ˜G69, T69C; G7A, ^C66, ˜G74; ˜T65, ^A79; T65G; G74A, A76C; G74T, G75A; ˜G68, G77T; T9G, G79T; ^AG67, A88C; ˜C81; ^A67, G78T; C37A, G57T; G54C, G79T; G75T, G77A; G40A, TAG52CCT; ˜G15; C67A, C68A; A36T, ˜C55; A36T, T59A, T65C; C67T, ˜G68; T71C, A76C; G7C, A29G, T65A; ^A78; T69C, G75T; ˜TC66, A88C; CT2_, T59A; T9C, G17C, T65G; C70G, G75T; C2_, C73T, G75A; TG3CC, C6G, C8T, G28A, G30C, CA32GG; C64G, C66T; T11C, A29C; T9C, ˜G15, G17C, T65C; T69G, G74T; ˜GA65, A88C; G7C, A61G; ˜T65, ^A80; C68_, ˜C79; G7A, ˜T29, G79T; A27T; A1_, T9G, T59C; T14G, -G.79.TT; T14C, T16A; C70A, G74T; T65A, G78A; ˜T65, ˜G77; T9C, G17C, ˜G68, G77C; C66A, ^A79; G7T, T9C, G17C; ˜G69, A76T; C2_, A21C; ˜T29, A29T; ˜G69, ˜T69; C6T, T10C, T84G; T65C, C67T; C15T; G78C; G7T, A27G, C44T; ˜C68, ^A68; A1G, T9C, G17C, A76G; A36T, T59A, T14A, T16A; ˜C66, G79_; -T.3.AA, G7_, AG29GC, CA32TG; C8G, ^A70, ˜T75; C66A; ˜C64, A80_; T69C; T71G, A76T; CT68TC, G74A; G54C, C68T; T9C, G17C, G81T; C2_, A13G; T65A, ˜C81; ˜C66, ^A78; ˜C70, ^A75; ˜T68, G77T; A29T, C50T, A53G, G79T; C68T, A76T; T16C, A18T, A80C; ˜TGGAAGAT63, C---.66.TCGG, C68A, GGAGGGAG74_, ^A83, A86C; -T.3.AA, G7_, AG29GC, CA32TT; T9G, A29G; C68A; A27C, A29T; A36T, G54C; ^A4; ^A73 |
| 2.2 to 2.3 | ˜C66, A76_; ˜G65; ˜T1, T59C; A36T; T3C, GCG5CGA, AGC29TCG, A33G; T9C, TG16GC, C68T, G79A; G7A, T14A, G17A, T34A; T65G, G79T; G7C, TC14CT, G17A, T34A; T3C, C67A, G77C, G78T; C2T, ˜G56; C6T, A83G; G7T, C8A; C66G, G79_; TG3_, C--.8.TCG, ˜C28, ˜C30, CA32_; C67T, T69G; CT2_, T9C; G78T, G79A; C2_, T9C, C15A, G17C; T9C, G17C, ˜TG67; G75T, A76C; ˜C76; G79A, A80T; TT71GG, G74C; C70_, G75C; ˜G66, G79T; T34A, A60G; A29G, C64T, C66A; ˜CT29, A88C; ˜G69; A53C, G79T; ˜T80, A80G; ˜G67, C67A; C67A, G78C; T9C, G17C, C70T, T72A; -T.3.AC, GC.7.A-, A29_, A-.33.GT; C2G, ˜T58; A27G, ^A70; A39G, G78C; -G.78.AA, A80C; C66G, C67A; ˜G68, ^A68; T69C, T71A; G7T, G40C, AG53GA; T9C, G17C, G79T; C8A, C66T; G74T, A80C; G7C, T14G; ˜C77, G77T; G58T, G79C; T14C; ˜T65, ^A80, A88C; C68A, ˜C77; GC--.63.ATTA, CCC66ATT, G--GG.77.AATAT, GC81AT; T11G, A29T; T14A, T16G; T71C, G75A; ˜T67, ˜C78; T65C, G81A; G79C, A80T; ˜C66, ˜G74; A53C, G54A; ˜C66, ˜G74, A88C; G79C, A80G; T9C, G17C, ˜C66, ˜G74, A88C; C2_, T16C; T69C; ˜G68, ^A76, A88C; T71A, G74C; G74T; G7T, C37A; ˜CA68, A88C; ˜T12, ˜G12; A29T, C64T, C70T; G7C, A29G; G7A, T14A; T69C, C70G; G79T, A80C; C2T, G54C; ˜T58; G7T, G30A, G81T; A29C, A83G; C2_, T69C; T3C, G5C, G7C, A29G, C31G, A33G; T72G; C64A; T34G, T59C; A1G, A60C; T65A, G79A; A27T, ˜C29; ˜G67, ˜G77; ˜G68, C68A; C64G; C66T, G77A; ˜C64, ^A80; C2_, C73T; A29G; ˜T7; A1_, A46C, T59C; T9C, G17C, A76T; G78C, A80G; ˜C66, A76C; ˜T29, ˜T29; A27T, CT68TC, G74A; G75C, A76C; ˜TT81, A88C; ˜G77, A80G; ˜C5, G7T; ˜C66, T69C; C15A, T16A; C73T; ^A65, ^A80; ˜T65, G79_; G40A, T52C; G7T, A60T; TG3GA, GC7CA, A29G, CA32TC; ˜TA70, A88C; ˜C66, ^A66; ˜G67; A36C, ˜T55; C68T; T65_; ˜G63_, C82_; ˜C2A, A29G |
| 2.1 to 2.2 | A83G; G75_; ˜C68_, G79_; C2_, A46C; ˜C4; ^A69, ^A69; G42A, C50T; A53G, ˜T55; A36G, ˜C58; TG3AC, C8A, GA28TC, CA32GG, T59C, C66A; C2_, A46C, C66T; C64T, G81T; ^A68, G77T; ˜T80, A80T; T25G, A29T; G4A, C32T, G54_; ˜T68; A76C, G78A; T9C, T14C, G17C; CT2_, A33C; ˜CA65, A88C; A60C; ^A69, ˜T69; T9C, G17C, -T.65.GC; A18C, A61G, A80C; CT15TG, A21C; T72G, A76T; G7C, A29C; ˜G79, ˜C79; T69G, ˜T76; C70A, G74C; |

TABLE 19-continued

Guide 174 mutations and resulting relative enrichment

| Log$_2$ enrichment | Mutations on gRNA scaffold 174* (SEQ ID NO: 2238) |
|---|---|
| | T9G, A29C; C2_, G54A; C15G, T72A, G74A; ^A75;<br>T3_, C6T, ^C8, A29_, C32A, ^C34; ^C29, A80C; G74A, A76T; C68T, T69C;<br>T3_, C64T; A80T; CT2_, T9A; ^C29, A36C; ^GA67, A88C; T9C, G17C, T59A;<br>A60T, C64T; T65A, G79T; A29C, T65C; ^T7, A13C; C8A, C82T; A76G, ^C77;<br>T3G, GC7CT, GA28AG, CA32AC; ---TT.71.AAGAA, G75_; G7T, C15G;<br>^C79, ^C79; TG3GA, CG6AC, A29G, CA32TC, C68T, T72C; T72C; G63C, C82T;<br>^TG56, G57T; T14C, A29T, A36T; ^T68, ^T68; T69G, T71G; ^G66, C66T; ^G68,<br>G77A; G54C, G79A; G7T, C67G; C66G, G78A; A60C, A76G, A80G; G40A, -A.76.CC;<br>C2T, C67A, ^T78; T9C, G17C, G77A, G79T; G77T, G78A; ^T78, ^C78; ^T68,<br>G77C; ^A67, ^G77; C73T, G75A; A29T, C66A, G74T; C2G, A36G; T3G, G5A,<br>GC7CA, A29G, C31T, A33C; T69A, T71C; ^CG2, G5_, C8_, --G.28.CGC,<br>CA32_; ^GT79, A88C; C68A, G77T; C64T; G40A, G77C;<br>C68G, C70G; C2T, G78A; T9C, G17C, ^C66, A76C; G7T, A29G, C82T;<br>C2_, T65G, A80G; TGG3GCT, C8G, ^CC28, CC31_; A29G, T69C, A80G;<br>T34A, A36_; T9C, G17C, A27G; C15T, T16C; G7T, T9C, G17C, G40A, TA52AT;<br>A36G, T71A; C6T; ^G69, A76_; C66A, G79A; ^C68, ^T68; A21T, C67A;<br>A21C, T72G, G77T; T71G, A76G; C2T, G54A; T71G, G77A;<br>T9C, G17C, A29G, G81A; G7A, A36T, G54C, C68T; T3A, T59A; ^G70; ^T77;<br>^T68, ^C77, A88C; TC14GT, T72C; T9C, G17C, T72_; ^C73; G7C, T14C;<br>A36T, ^T58; G54T; T59C; A29C, C50T, A60T; G54A, C70G, ^T75; ^C66, G77C;<br>C15G, G17C; C64G, ^C81; T3A, G5C, GC7AG, GA28CT, C31G, A33G; A29C,<br>C32A; ^G28; A21G, A53G; G75A, A76T; G7C, TC14CT, G17C, T34A; G28A |

*mutated sequences are ';'-separated and multiple mutations per sequence are ','-separated

TABLE 20

Guide 175 mutations and resulting relative enrichment

| Log$_2$ enrichment | Mutations on scaffold 175* (SEQ ID NO: 2239) |
|---|---|
| 3.2 to 3.5 | C73A, ^T78; C6T, A29C, G71C, ^G80 |
| 3.1 to 3.2 | C17G, A87C; T3G, CGC6ACT, GAG28AGT, A33C; G7T, C9T, C17G, CG81GA;<br>T16G, A29C; C9T, C17G, C65A, A87G |
| 3.0 to 3.1 | A68T, T83G; A27G, T92C; TGG3ATC, GC7AG, GA28CT, CCA31GAT;<br>^C65, A87G; G7T, A29T; T3G, GC7AA, GA28TT, A33C; C9T, C17G, C65_;<br>G7T, T14G; ^G54, G78T; C9T, C17G, ^A80; TC16AT, G64C |
| 2.9 to 3.0 | C15T, T34A; C9T, C17G, A88T; G7A, C15G; ^C76, ^G76; CT2_, C15_, T58A;<br>C2_, C15G; C9T, A29C; C9T, C17G, A85T, A88T; C9T, C17G, ^CA63; G7T, C9G;<br>A87T, A88C; C73G, G78A; A29T, A91G; TG3GA, G7A, A29G, CA32TC;<br>^G14, A29T, A87G; C9T, C17G, T74C; C2_, ^A53 |
| 2.8 to 2.9 | C9T, A33T; G7T, T67G, G82C; ^T5, C9_, GAGC28CGCA; G7T, ^A68, ^A82;<br>G7T, ^C60; T14G, A29C; A29T, T66A; T3A, CG6TC, AG29GA, A33T;<br>C2T, TC75AT; ^CG76, A88C; G7T, T14A, T83_; -T.3.GA,<br>C6T, C9_, G28C, G30C, CA32TC; CT2_, C15T; TG3_, ^GT8, G30C, C32G;<br>T14_, A29C; C9G, C17G, A29C, T79G;<br>TG3AC, G7C, A29G, CA32GT, G86C, A88C; T3A, GC7CA, A29G, A33T;<br>G7C, C80A |
| 2.7 to 2.8 | G7T, A91C; ^C2, G4C, G7_, A29_, C32G, ^G34; CT2_, A88C; C65G, A88C;<br>G7T, -T.79.AA; A29C; T3A, GC7CA, A29G; C8G, A29C, A88_; A29T; C2_, A29C;<br>A29C, C31T, A33G; T14G, C15T; C9T, C15A; ^GA1, G7A, C15A, C17G;<br>C15A, T16A; CT2_, A29C; C9T, C17G, G78_; C9T, C17G, G-.78.AT; C73T, C76G |
| 2.6 to 2.7 | C9T, C17G, C65_, ^A84; C9T, C17G, G70T, C81A; T74A, T79A;<br>T3C, C6T, AG29CA, A33G; G7A, ^T29; C76G, G77C; GG77CA, A87G;<br>T16G, A29T; T3A, G5A, A29C, C31T, A33G; C9T, C17G, ^AA53;<br>TG3CA, GC7AA, GA28TT, CA32TG; G7A, A29C; T3G, G7T; CT2_, A68G;<br>T14_, A29T; C2_, C9T, C17G; ^G3, GC.7.-T, G28_, ^C34; G7T, ^T92;<br>G7T, ^G69, G82T;<br>^GGCAGATCTGA64, T66C, A68C, GA71AG, ^C75, G77T, T79C, CGTAAGAA81_;<br>T3A, C6G, AG29CC, A33T; C80T, ^A81; C81T; CT2_, C17A; C15A, T16G;<br>C2_, T16G; G71_, C80T; TG3AC, GC7AG, GA28CT, CA32GG;<br>T3A, G5C, G7T, C31G, A33T; T3G, G7T, C9T, C17G; G64T, A85T; G7C, T14_;<br>C9T, A29T; G7T, ^G14; A88G, ^C89; CT2_, A33T; C81T, ^A82;<br>C9T, C17G, A29C, C32A; C9T, C17G, ^GA77 |
| 2.5 to 2.6 | G7C, C15G; C9T, C17G, TC75GT; TG3CA, CG6GA, AG29TC, CA32GG; G7T;<br>T14A, T16G; G7T, C9T, G71_, ^T79; C15A; CT2_, A33T, C73_; C2A, C9T, C17G;<br>CGC6TCA, GAG28TGA; C15G, A29C; C2_, T16G, A91C; ^T81, C81T;<br>TG3AA, A29C, CA32TG; G4A, G7T, C32T; T3C, CGC6GCT, GAG28AGC, A33G;<br>T3A, G7A, A29C, A33G; -G.4.CC, G7_, AGCC29GCGG; C65T, G86_; C9T, ^A16;<br>A36G, ^C57; A1_, T16G; C6T, G7T; ^G14, A29T; ^AT16, A88C; C8G, A29C;<br>^G64, A87C; ^G70, ^T79; T16A, ^C29;<br>TG3GA, C6G, C8T, GAG28ACC, CA32TC, G71T; G7T, A29C; |

TABLE 20-continued

Guide 175 mutations and resulting relative enrichment

| Log₂ enrichment | Mutations on scaffold 175* (SEQ ID NO: 2239) |
|---|---|
| 2.4 to 2.5 | T3G, GCG5AGT, GC30CT, A33C; ˆC2, ˜T14, A29T; C9T, C17G, A88__; C9T, T16A TGG3ACA, A29C, CCA31TGT; T3__, G5A, G7C, ˆG9, ˆC28, A29G, C31T, A33__; C15A, A29T; G64A, ˜T65; CT2__, A27G; ˆA16, ˜T16; G7T, C15A; G7T, C9T, C17G; C2G, A29T, T66A; TG3GA, CGC6TTA, G28T, G30A, CA32TC; A1C, G82C; A27C, A29C; C9T, C17G, ˆGA71; T3C, ˜T6, CC.8.T-, C17G, GAG28AGA, A33G, ˆG54; ˜T16, A27T, A29C; G64C, ˆA87; ˆC14, A29C; ˆA65, ˜T65; C2T, C9T, C17G; C9T, C17A; G70A, C81A; C2G, A36T; G5C, C8G, GA28CC, CC31GA; C6T, A29C; C80T, ˆG81; T-.3.CA, G7__, AG29GC, CA32TG; ˆC78, G78A; G7A, T14__, CT65TC; -T.3.AA, G7__, AG29GC, CA32TG; ˆC29, A29T; G7A, A29T; TG3GA, GC7CA, A29G, CA32TC; ˜T64, G64A; C15A, A29C; T75A, G77T; ˆA3, ˜T3; A27T, A29C; T14A, A29C; T74C, G77A; G7C, A29G; C9T, C17__; G5A, G7A, A29T, C31T; ˆC63, ˆA63; G7T, A91G |
| 2.3 to 2.4 | CT2__, G64T, T66G; G28T, A29C; T3G, G5T, GC7CG, GA28CG, C31A; TG3AC, G7C, A29G, CA32GT; C9T, C15A, C17G, A29C, ˜TG55, G57A; ˆC14, A29T; C9T, C17G, GC64TG; G7A, ˜T29, A36C; ˜T16, ˆG54; TG3CA, C8A, GA28TC, CA32GG; G7T, C9T, C69G; C9T, C17G, ˆA70; A72__, T79G; T3A, G5T, C8T, GA28AC, C31A, A33T; C9T, C17G, A29C; ˆG54; G7A, TC14CT, C17A; C9T, C17G; ˆG70, ˜T79, A88C; ˆA64, ˆG64; T14G, A29T; C9T, T16__; ˆA14, ˜T14; ˆAC1, GCG.5.--T, GC30__, ˆGT34; A29C, A91G; C2__, T14A; C9T, ˆA17; C9T, C17G, G78A; T3G, G5A, A29C, C31T, A33C; C9T, ˆG17; G7T, A29G; TG3GA, C6G, C8T, GAG28ACC, CA32TC; ˜T1, CG6TC, C9T, C17G; C17A; ˜T17, ˆA17; T3A, G5C, GC7AG, GA28CT, C31G, A33G; ˆGC72, A88C; T3G, G7T, A33C; TG3CA, CG6GA, AG29TC, CA32TG; T3G, G5C, C8G, GA28CC, C31G, A33C; ˜T3, C80G; C9T, C17G, T45G, ˆG54; C9T, C17G, A72C, T74G; G5C, C8G, GA28AC, C31G; A29T, G56T; G7T, C63A |
| 2.2 to 2.3 | A36T, A85C, A87T; T14A, C17G; C9T, C17G, ˆG54; G4C, C8G, GA28AC, C32G, A87G; ˜T72; A85C, A87C; G7T, T92C; C9T, C17G, ˆC63; TG3AA, C6T, AG29CA, CA32TT; C9T, C17G, A85G, A88G; G64C, ˆG88; G7A, ˜T29, A68C; ˆA13, T14C; C9T, C17G, ˆG54, A85C, A88C; -GG.4.CAT, C9__, GAGCC28CGATG; TG3AC, C6A, AG29CT, CA32GG; C9T, ˆC63; C9T, A88C; A27T, A29T; C9T, C17G, ˆG54, A91C; G86A, A88T; TG3CA, GC7AA, GA28TT, CA32TG, C69T; T74G, G77T; TGG3ACA, C8G, GA28CC, CCA31TGG; G7A, C17A, ˆG81; G7T, A59G; ˆA65, ˆG86; C73T, G78T; ˆC72, ˜T79; A1G, C9T, C17G; ˆG1, C9T, C17G; ˆG72, ˆC72; C2__, A29T; ˜T14, A29T; ˆG64, ˜T87; ˆA65; ˆC18, ˜T18; ˆG64, A88C; C9A, A29C, G57T; G7C, ˆG28; G77A; G7A, TC14CT, C17G; C2__; G7C, T14A, ˜T86; C9T, C17G, A53G; T3G, GC7CT, GA28AG, G86T; C9T, C17G, A29C, A91G; C9T, T16__, A91C; CT2__, ˆG64, C65A; C15__; T16G, C17T; G7T, G28A |
| 2.1 to 2.2 | C9T, C17G, A29T; A87C; ˆCT18, A88C; C9T, C17G, ˆG64; C17G; C15T; ˜T16, T79C; ˆA64, G64A; A1C, T3G, C9T, C17G; GA28CC, ˜T65; C15A, C17A; G78C, T79G; A29C, T58G; C2__, G7A, -C.65.AA; CT2__, A29T; T3A, A33T; G4A, CGC6GTA, G28T, G30C, C32T, T67__; C9T, C17G, C65__, A91C; ˜T65, A87G; A88__; G7T, C9A; C9T, C17G, C65A; TG3GC, C6T, AG29CA, C32G; G7T, T16A; G7T, G70C, C80A; G7T, T14A; TG3AA, GC7CG, GA28CG, CA32TG; ˆG54, A91C; C73__, G78__; T3C, GC5TG, C8T, GA26__, G30A, ˆCG34; ˆCT3, A29C; C2T, T14G; G7C, A29T, TC16GG; T3G, C8T, GA28AC, A33C; ˆG16, ˜T16; C9T, C17G, A36C; TGG3AAC, C8G, GAG28__, A---.33.GGGT; C9T, C17G, A87G; ˜T72, T79G; ˆG17, C17T; CT2__, A39C, A88C; T3G, A33C; T3__, A33G; C-.2.TG, TC75CA; G7C, C9T, C17G, ˆG92; C9T, C17G, G82C; C9A, A29C; C2__, C9T, C17G, A91C; C2__, A29C, A91C; CT2__, C9T, C17G; G7T, A60G; ˆC71, ˜T71; C2__, G77T, A91C; C2__, A29G; ˜T71, C80G; T3A, G7A, A29G, A33T; C9T, A29G |
| 2.0 to 2.1 | C65T, ˆA66; CT2__, C15__, T58A, A72C; C9T, C17G, C73A, C76A; C2__, A91C; C80T; T3A, G7C, C9T, C17G; ˆC63, ˆG88; G7T, A61T; GC62__, C65G, T67G, A72T, T79A, AAGA.84.---C, G89C; T3G, C9T; T16A, C17A; C6T, A29T; T3C, GC5CG, C8T, GAGC28ACCG, A33G; G7A, C15T; ˜T2; C15G; C9G, A29T; C15T, A29T; G7T, ˆC14; ˆA64, A88T; A29C, G30A; C2__, A29C, A46C; C9T, C17G, A72G, G78A; ˆA87, ˜T87; C9T, A59C; TG3AC, C8A, GA28TC, CA32GG; C9T, C17G, ˆG64, ˆG88; A29C, G71A, C80T; T3C, A29T, AC68TA; ˆA17; C9T, C17G, G64T, T66C; G7A, T16G; C17T, C65G, G86C; C69T, G82C; A1T, C2A; T14A, ˆC29; ˆA15, C15T; G7T, T16G; T3A, GC7CA, GA28TG, A33G; ˜T81; T16C, A29C; A29C, A91C; G71A, A88T; ˆC65, A87G, A91C; C9T, C17G, A29T, ˆA53; G71T; ˆA80, ˆA80; C9T, C17G, A36G; C9T, C17G, T--.54.CTG; T16A, A29T; ˆG77, T79C; C9T, C17G, G64C; TG3AC, CG6GA, AG29TC, CA32GG; A36T, C37T; A29C, ˆC65, A85__; C15G, A29T; ˆA70, C81T; A29T, A33G; C73A, C80T; C9T, C17G, G82__; C9T; C69T, A84C; C2__, C9T, C17G, A46C |
| 1.9 to 2.0 | C2__, A29G, A91C; A68G, T83C; C9T, T14A, C17A, ˆAG85; ˜T66, ˆG85; G62T, CT65__, C69A, G71A, C80T, G82T, A85C, AGC88__; T3__, G5T, ˆA8, -A.29.TC, C31A, A33__; G7A, T14C, C17A; T3G, CG6TC, AG29GA; ˜T54; ˆC8, ˜T8; G7T, AA87TG; A72C, C73A; C2__, C6T; ˆC29; G71C, C81__; C9T, C17G, G64__, A88__; C2__, A88T; T3G, G5C, GC7TG, G28C, C31G; |

TABLE 20-continued

Guide 175 mutations and resulting relative enrichment

| Log₂ enrichment | Mutations on scaffold 175* (SEQ ID NO: 2239) |
|---|---|
| | C9T, C15T, C17G, A36C; G7T, T34G; T14A; ^T73, ^C78; ^G64; ^G15, C15T; A36C, ^A57; A-.72.GC, ^T79; T16A, A29C, ^A58; C9T, C17G, ^T52; C2_, A85T; ^C29, A29G; G7T, T14C; C2A, ^T57; G7T, C15G, T34G; T14G, C17T; T14C, C15T; T3G, G5A, GC7TA, G28T, C31T, A33C; ^C71, ^T79; ^T14, A29C; ^A1, A36C; ^C63, ^G89; G7C, A91G; T14C, A29C; C9T, C17G, G78T, C80T; ^G69, G82C; TGG3GCA, G7T, CCA31TGC; C6T, A29C, G71C, ^G80, A91C; A13C, A29C; ^C63, A88T; G7T, T14_; C2_, GG77AA; C9T, C17G, T58A; C2_, G77T; C2_, T3_; C9T, C17G, ^AA53, A88C; G7T, C9T; G7A; CG6GC, AG29GC, C32A; C63T, TTA66GCC, GA71_, TC79_, TAA83GGC, A87G, G89_; G7C, C17G; C2_, A46C; C9G, A29T, C37T, ^A56 |
| 1.8 to 1.9 | ^G69, A72C, G82C; ^G70, T79G; G7A, C15A; ^T36, ^A57; ^G70, ^C79; TGGCG3CACAT, GCCA30TGTG; G71A; TG3AC, C8A, A29C, CA32GT; T10G, A29C; ^A65, G77A, ^G86; C9T, C17G, A88_, A91C; ^C78, ^A78; G7T, C90T; T3G, G5A, GC7TG, G28C, C31T, A33C; G7T, C9G, G86T; A29C, C31T, A33C; A29C, G70A; A-.88.GC, A91C; ^A17, A36C; T3C, GCG5TGA, AGC29TCA, A33G; T3C, CGC6GCT, GAG28AGA, A33G, A88C; C35G, ^C58; T74A, G78C; C9T, CA17GT; G7A, C17G; C9T, C17G, ^GT70; CTG2_, A29C; C2_, A68G; ^T64, ^T88; T3G, A33T; C2_, T16G, A29C; ^A1; A36T, ^G55; C9T, C17G, C63A; C9T, A18G; C2T, A36T; ^A81, ^A81; C9T, T14G, C17G; -A.72.CC, A91C; A29T, T79G; G7A, A29T, A59G; G7C, ^C78; ^AG64, A88C; CT2_, C9T, C17G, C69T; C2_, A46C, A91C; ^C89, A91C; ^C29, A68C; C2_, G64T; -C.15.GT, A27C; CT2_, T10G, A88C; T14C, A29T; C9T, C17G, C76T; A84G, A87C; G7C, C9T, T14A, C17G, T34A; G70T, C81A; T14G; ^T3, A29T; G7T, ^T29; A29T, C65A, T67G; G64C, A87G; C9T, T14A, C17G; ^T57, A87G; TGG3ATC, A29C, CCA31GAT |
| 1.7 to 1.8 | C2_, G70A; C9T, C17G, ^GA77, A88C; C9G, C17G, A29C; ^T70, ^T81; G7C, C9T, C17G; T3G, CGC6TTG, G28C, G30A, A33C; ^A16, A68T; C9T, C17G, T67C; G7T, ^C14, A33C; G7A, T14_; ^C14, ^T14; C9T, C17G, GG77TT; C2T, C80T; ^T64, A88_; ^G54, A68C; G7T, CT9AG; C9T, C17G, T79G; T79G, C80T; ^AT3, A88C; ^AG54, A88C; C2G, A33C; C2_, A88T, A91C; C9T, C17G, T58C; C2_, C73T; TGG3CCC, C8G, GA28CC, CCA31GGG; G7T, T10G; C9T, C17G, ^A80, A91C; ^T64; T14_, A29C, A91C; G7A, G28T, AAAGCGCTTA59_; G7T, G71_; ^A17, ^A17; T14_, A29T, A91C; C17G, A72G, T74C; ^T88; CT2_, A94C; A27G, A29C; A85T, A87G; C9T, C17G, ^AA79; C9T, T14A, C17G, T34A, ^G64, G86T; C9T, C17G, T45G; C2_, C9T, C17G, C65T; ^G3, G5C, C9_, GA28CG, C32A; T74G, G78T; TG3_, --C.8.GCT, G28_, ^G33; A39T, T54A; C2_, A72G; C9T, C15T, C17G; TG3CA, CG6GA, AG29GC, CA32TG; G64C, A88G; C15A, C17G; C2_, C65A; ^G64, G86A; ^C29, A36C; G64T, T66A; TG3GT, A29C, C32A; ^A64; C81G; C9T, A72T, T79C; C9T, C17G, G77T |
| 1.6 to 1.7 | A72G; ^C14, A29C, A36C; T3C, C9T, C17G; G4C, C8G, GA28AC, C32G; C2_, G71C, ^G80; C76T; C9T, T14A; C2G, C9T, C17G; G70T, C81G; C17G, ^T54; A72C; C2_, C9G, C17G; TG3GC, C8T, GA28AC, C32G; TGG3GCT, C8G, ^CC28, CC31_; C9T, C17G, A39T, A-.53.GC; ^T16; T67C, A87C; ^G81, C81T; C76G, G78C; A1C, G56A; TG3CA, GC7AG, GA28CT, CA32GG; C9T, C17G, C65G, ^A87; G86A, A88C; G7T, C9T, C17G, ^A72, G78A; ^G70, C80A; ^A17, A68C; C2_, C80G; ^C71, ^T79, A88C; C9T, C17G, ^T57; ^T2, C9T, C17G; T45G; G64C; T14_; C65T, G86A; C69T; ^C65; G64T, C65A; T3G, GC7CT, GA28AG; ^A1, ^A53; T3A, G5C, GC7AT, GA28AT, C31G, A33T; C9T, C17G, ^CA72; C9T, C17G, C73A, T79A; C2_, A53G; TGG3GTC, C8G, GA28CC, CC31GA; ^C5, G7T, C9T, C17G; G71C, C80T; C15T, T16G; G7C, C9T, C17G, C76A, G78T; G64T, T66C; ^C65, A91C; C73T; A72C, G78T; ^C63; A68G, C81T; ^GT87, A88C; C9T, C17G, ^A78; T3A, GC5AG, C8T, GAGC28ACCT, A33T; ^A1, ^T54; A29C, G56A; C2_, C80T; ^TA17, A88C; A72G, C73T; A29C, C31T, T83C; G7T, A27T; T3C, G7T, G40A, ^T54; A88C;; G64T, A87C; T3_, ^T9, G28_, ^G32; ^GT16, A88C; -T.3.AC, G7A, C9_, GAG28TGC, CA32GG, A84C, G86T; ^T65; C76A, G77T; ^G14, A29C; G64C, A88C; A72_, T79G, A91C; ^C29, A68C, A72C; TG3AT, GC7TT, G28A, CA32AT; C9T, C17G, T--.54.CTG, A88C; G7T, A59C; CC8GT, C17G; G7C, T14C, ^T86; ^CA3, GC5_, C8G, GA26_, G30C, ^TG34 |
| 1.5 to 1.6 | T3A, ^A5, G7_, AGC29GCT, A33G; C9T, C17G, ^C73, G78C; G71A, A72G; AG27TA, A88T; G7T, A91T; ^T57, A91C; ^T2, A68C; ^T2, A36C; G7T, T10C; ^A64, A88G; TG3CA, C6T, C8T, GAG28ACA, CA32TG; ^T54, A68C, A72C; G7T, A61G; GCGC5CAAG, GAGC28CTTG; C6T, CT9TC, C17G, A29C; ^CA63, A88C; C2_, C9T, C17G, A36C; ^G64, ^G86; ^CGGCAGAT65, T67G, ^GC69, G70T, A72G, ^GCTC75, G77T, T79C, CGTAA81_; C73T, ^G74; T14G, T16A; ^AT14, A88C; G64C, A88T; C2_, A39T, ^A55; C2_, C15T; ^G70, C81T; ^A81, C81T; ^T72, A72T; C2_, C69T; T75G, T79G; A88_, A91C; ^T7, G7T; G7A, A29T, ^A77; CC8AT, C17G; C2_, T52C; G7A, C9T, TC16CG; G70A; C9T, C17G, AA87TC; ^A53, A91C; T3A, G5C, GC7CT, GA28AG, C31G, A33T; ^G70, ^C79, A88C; ^T72, ^G77; C9T, C17G, C69T; T-.3.CA, G7A, C9_, AG29GC, CA32TG; TGG.3.-AA, ^G9, ^CGC28, A29T, CCA31_; GCGC.62.--AA, T67C, C69A, GA71AC, TC79GT, G82T, AAGA.84.---G, GC89TT; A85G, A87G; TG3_, C--.8.TCG, GAG28CGA, C32G; T66C, A85G; |

TABLE 20-continued

Guide 175 mutations and resulting relative enrichment

| Log₂ enrichment | Mutations on scaffold 175* (SEQ ID NO: 2239) |
|---|---|
| | ^A16, G86T, A88T; TT74GG, G--.77.AAC; C2_, T79C; C9T, ^A13, C17G, ˆG54; ˆC63, G64T; C2_, T83C; ˆC73, ˆC73; -T.3.AA, G7_, A29_, A-.33.GT, G70A; ˜T16, A91C; ˜T64, ˆG64; T79C; C9T, C17G, G77A; ˜T64, ˜T64; C2_, G71A; T14C, C17G; G7C, TC14CA, C17G; A85C, A88C; ^A3, GG4TC, C9_, GA28CG, CCA31AAT; --C.63.TTT, C65_, CGGA.69.T---, TCCG.79.---A, G86C, G89A; C9T, C17G, ˆC57; C15G, T16A; C9T, C17G, ˆCA64; AG39TA, T52C, T54A; C2A, A87G |
| 1.4 to 1.5 | -C.15.GT, A36C; A29C, T83C; G7T, A27G; ˆC29, ˆC29; ˜T80, ˆC80; TGGC3ACAG, GA26_, --A.33.TGG; A72G, ˜T73; C9T, C17G, T66A, A85G; ˆC15, ˆG15; TG3_, --C.8.GCT, GAG28CGC, C32G; ˜T19; G28A, A29C; ˆG70, ˆG80; CT2_, A36C, A39C; C9T, C17G, ˆCC79; ˆG54, A68C, A72C; ˆCT78, A88C; T74G, G78C; TTC74AGG, ^AT78; C9T, C17G, C76G; ˆGGCAGCTCTGA64, T66C, A68C, GA71AG, ˆC75, G77T, T79C, CGTAAGAA81_; ^A1, A68C; ^A4; A72G, G78C; T3G, C8T, GA28CC, A33C; G7C, -C.80.AT; C9T, C17G, A59T; G26C, C93G; G7C, T14A, ˜T86, A91C; ˆG64, ˜T87, A88C; A1G, A29C; C9T, C17G, ^AT78; G28T, GCCA30TTTG; C2_, T75A, G78A; TG3GA, CG6AC, AG29GT, CA32TC; A36G, ˆC57, A91C; ˆC72, A72C; C9T, C17G, ˆG82; A27T; TG3CC, CGC6TTG, G28C, G30A, CA32GG, C80G; ^A1, ^A53, A88C; A72C, C80A; G7T, C73G; ^A15, A87G; T14_, ˆC29; G7A, T14_, A91C; C15T, T16A; C15T, C17G; C65_, A88_, A94C; ^A16; C9T, C17G, ˆG54, A68C; -T.3.AC, G5A, C9_, GAG28CGT, CA32GG; ˜T15, ˆC15; C9T, T14A, C17G, T34C, ˆG64, G86T; ˜T71, C80G, A91C; -C.15.GT, A68C; ˆG87, ˜T87; C73_, G78_, A94C; C2G; G77C, T79A; G70C; A68G; ˜T81, A91C; C9T, C17G, T79A; ˜T72, ˜T72 |
| 1.3 to 1.4 | T66A, A88C; C76G, G77T; A53G, A59C; CTG2_, G7T; A72_, ˜T79; ^AA80, A88C; TGG3CAA, C8G, GA28CC, CCA31TGG; ˆC78, ˜T78; --G.28.TGA, T79C; ˜T72, ˆG77, A88C; A72G, ˆC79; T3G, G5A, G7A, A29G, C31T, A33C; T14G, A21G; ˜T2, A72C; G7T, T14G, ˆCG64; T3G, G71A; G64A, A87G; T3C, C6T, AG29CC, A33G; T45A; G7A, C9T, T14A, C17G; TG3CT, CGC6TAT, GAG28ATA, CA32AG; C9T, C17G, ˜T83; G7T, C9T, A53T; C9T, C17G, T75G; G7C, T14C, A72_; ^A65, A87G, ˆC89; C9T, C17G, G70C, C81G; G7T, A59T; AG29CA, A72T, ˆG77; T74C, G78A; C2A; C9T, C17G, C73T, T75G; ˆG54, A72C; ^AA81, A88C; ˜T54, A68C; C65A, G86A; ^A1, A72C; T3G, C9T, C17G; C2_, A33T; A87T; ^A65, ˜T86; A53G; A85G, A87C; T3G, G5C, GC7TG, G28C, C31G, TC75_; -T.3.AC, G7A, C9_, GAG28TGC, CA32GG, G71T; G7C, C15A; G64A, A85G, A88_; ^A74; ˜TG64, A88C; A29C, A60T; C9T, C17G, C80G; ˜T64, ^A87; G7T, ^A59; G77C, G78C; A72C, ˜T79; ˜T73, ˆC78, A88C; ˆC29, A91C; ^A64, A88C; ˆG54, T58A; TGGCG3CACTT, GCCA30AGTG; C9T, C17G, A21T; G4C, C8G, GA28AC, C32G, ˆG82; A36C, A53G; C9T, C17G, G71T; C9T, CA17GT, T45A, G70C; ^A81; G7A, A72T; CT2_, T10G; G64T, A87G; ˆG70, T79A; C2_, C9T, C17G, T52C; C2_, T45C; C9T, C17G, ˆC35, A36G; G7T, T58A; ^A73, ˆC73 |
| 1.2 to 1.3 | C2G, C73G; G7T, ˜T14; T75C, C76T; ^A80, ˆC80; A1_, A46C; C9T, C17_, A91C; C35G, ˆC58, A68C; C2T, T3A; ˆC29, A72C; T79G, C80A; G71A, C81_; G7T, G28T; CT2_, T45G; A29C, ˆG92; C9T, C17G, T67C, A84G; T3C, ˜T6, C9_, GAG28AGA, A33G; A36T; A85C, A88T; TG3GC, C6A, C8T, GAG28ACT, CA32GC; T10C, A29C; A1_, C2_; ˆC65, A87T; A72T, C81T; C15A, T79A; ˆGA1, G7A, C15A, C17G, A88C; ^A16, T16A; A29T, A60C; C76A, G78A; A29T, C31T; A29C, G86C; ˆG70, T79G, A91C; ˜T54, A72C; ˆGAAC73, T74A, GG.77.C-; T14_, A29C, A46C; C9T, C17G, ^A72, ^A78; T14C, C15A; ^A17, ˆG17; C9T, C17G, CG76AC; T74C, T79C; G7A, TC14AA, C17A; ˜T64, ^A64; ˜T81, ^A81; C2A, A36T; C9T, C17G, G82T; T74A, G77A; ^A1, A33C, A36C; G7C, TC14CT, T34A; A36T, A53G; ^A65, ^A84; A1_; G7T, ˜T60; T3A, G5C, G7T, C31G, A33T, T52G, ˆC54; T75G, G77T; G5C, G7A, A29T, C31T; TGGC3CCAG, C8T, GA26_, G30A, --A.33.TGG; C9T, ˆC17; C2_, T14A, A91C; G77A, G78T; ˆG64, G86A, A91C; T16A, C17G; C9T, C17G, T34A; A87G; A39G, -T.54.GC; A39G, -T.54.GC, A91C; ^A5, C6T, C9_, G28C, GC30CT; A72C, G77A; C2_, A91C, A94C; C2_, G7C; A84G; C73A, G78T; ˜T78, ^A78; TGG3GTC, C8G, GA28AC, CCA31GAC; G7A, ˆG14; C76T, G77A; C2_, G7T; G7A, T14A; ^A17, A68C, A72C; TGG3CCA, GC7CG, GA28CG, CCA31TGG; T79G; ^A72, ˆC78; C15G, A29T, G57C, A59T; T14A, ˆG74; G7T, C65T, A87C; C9T, C17G, G70T |

*mutated sequences are ';'-separated and multiple mutations per sequence are ','-separated

Example 14: The CcdB Selection Assay Identifies CasX Protein Variants with Improved dsDNA Cleavage or Improved Spacer Specificity at TTC, ATC, and CTC PAM Sequences Experiments were conducted to identify the set of variants derived from CasX 515 (SEQ ID NO: 416) that are biochemically competent and that exhibit improved activity or improved spacer specificity compared to CasX 515 for double-stranded DNA (dsDNA) cleavage at target DNA sequences associated with a PAM sequence of either TTC or ATC or CTC. In order to accomplish this, first, a set of spacers was identified with survival above background levels in a CcdB selection experiment using CasX 515 and guide scaffold 174. Second, CcdB selections were performed with these spacers to determine the set of variants derived from CasX 515 that are biochemically competent for dsDNA cleavage at the canonical "wild-type" PAM sequence TTC. Third, CcdB selection experiments were performed to determine the set of variants of CasX 515 that enable improved dsDNA cleavage at either PAM sequences of type ATC or of type CTC. Fourth, plasmid counter-selection experiments were performed to determine the set of variants derived from CasX 515 that resulted in improved spacer specificity.

Materials and Methods:

For CcdB selection experiments, 300 ng of plasmid DNA (p73) expressing the indicated CasX protein (or library) and sgRNA was electroporated into *E. coli* strain BW25113 harboring a plasmid expressing the CcdB toxic protein. After transformation, the culture was allowed to recover in glucose-rich media for 20 minutes at 37° C. with shaking, after which IPTG was added to a final concentration of 1 mM and the culture was further incubated for an additional 40 minutes. A recovered culture was then titered on LB agar plates (Teknova Cat #L9315) containing an antibiotic selective for the plasmid. Cells were titered on plates containing either glucose (CcdB toxin is not expressed) or arabinose (CcdB toxin is expressed), and the relative survival was calculated and plotted, as shown in FIG. 32. Next, a culture was electroporated and recovered as above, and a fraction of the recovery was saved for titering. The remainder of the recovered culture was split after the recovery period, and grown in media containing either glucose or arabinose, in order to collect samples of the pooled library either with no selection, or with strong selection, respectively. These cultures were harvested and the surviving plasmid pool was extracted using a Plasmid Miniprep Kit (QIAGEN) according to the manufacturer's instructions. The entire process was repeated for a total of three rounds of selection.

The final plasmid pool was isolated and a PCR amplification of the p73 plasmid was performed using primers specific for unique molecular identifier (UMI). These UMI sequences had been designed such that each specific UMI is associated with one and only one single mutation of the CasX 515 protein. Typical PCR conditions were used for the amplication The pool of variants of the CasX 515 contained many possible amino acid substitutions, as well as possible insertions, and single amino acid deletions in an approach termed Deep Mutational Evolution (DME) Amplified DNA product was purified with Ampure XP DNA cleanup kit, with elution in 30 µl of water. Amplicons were then prepared for sequencing with a second PCR to add adapter sequences compatible with next-generation sequencing (NGS) on either a MiSeq™ instrument or a NextSeq instrument (Illumina) according to the manufacturer's instructions. NGS of the prepared samples was performed. Returned raw data files were processed as follows: (1) the sequences were trimmed for quality and for adapter sequences; (2) the sequences from read 1 and read 2 were merged into a single insert sequence; and (3) each sequence was quantified for containing a UMI associated with a mutation relative to the reference sequence for CasX 515. Incidences of individual mutations relative to CasX 515 were counted. Mutation counts post-selection were divided by mutation counts pre-selection, and a pseudocount of ten was used to generate an "enrichment score". The log base two ($\log_2$) of this score was calculated and plotted as heat maps portrayed in FIGS. 33-36. Biological replicates for a single spacer are indicated, and the mean of these replicates was calculated and plotted as the overall enrichment score. For the experiment portrayed in FIG. 33, the library was passed through the CcdB selection with two TTC PAM spacers performed in triplicate (spacer 23.2 AGAGCGTGATATTACCCTGT, SEQ ID NO: 161, and 23.13 CCCTTTGACGTTGGAGTCCA, SEQ ID NO: 162) and one TTC PAM spacer performed in duplicate (spacer 23.11 TCCCCGATATGCACCACCGG, SEQ ID NO: 154), and the mean of triplicate measurements was plotted on a $\log_2$ enrichment scale as a heatmap for the measured variants of CasX 515. Variants of CasX 515 that retained full cleavage competence compared to CasX 515 exhibited $\log_2$ enrichment values around zero; variants with loss of cleavage function exhibited $\log_2$ values less than zero, while variants with improved cleavage using this selection resulted in $\log_2$ values greater than zero compared to the values of CasX 515. Experiments to generate the heatmaps of FIGS. 34-36 were performed using the following single spacers (11.2 AAGTGGCTGCGTACCACACC, SEQ ID NO: 163; 23.27 GTACATCCACAAACAGACGA, SEQ ID NO: 164; and 23.19 CCGATATGCACCACCGGGTA, SEQ ID NO: 157, respectively) for selectivity.

For plasmid counter-selection experiments, additional rounds of bacterial selection were performed on the final plasmid pool that resulted from CcdB selection with TTC PAM spacers. The overall scheme of the counter-selection is to allow replication of only those cells of *E. coli* which contain two populations of plasmids simultaneously. The first plasmid (p73) expresses a CasX protein (under inducible expression by ATc) and a sgRNA (constitutively expressed), as well as an antibiotic resistance gene (chloramphenicol). Note that this plasmid can also be used for standard forward selection assays, such as CcdB, and that the spacer sequence is completely free to vary as desired by the experimentalist. The second plasmid (p74) serves only to express an antibiotic resistance gene (kanamycin) but has been modified to contain (or not contain) target sites matching the spacer encoded in p73. Furthermore, these target sites can be designed to incorporate "mismatches" relative to the spacer sequence, consisting of non-canonical Watson-Crick base-pairing between the RNA of the spacer and the DNA of the target site. If the RNP expressed from p73 is able to cleave a target site in p74, the cell will remain only resistant to chloramphenicol. In contrast, if the RNP cannot cleave the target site, the cell will remain resistant to both chloramphenicol and kanamycin. Finally, the dual plasmid replication system described above can be achieved in two ways. In sequential methods, either plasmid can be delivered to a cell first, after which the strain is made electrocompetent and the second plasmid is delivered (both by electroporation). Previous work has shown that either order of plasmid delivery is sufficient for successful counter-selection, and both schemes were performed: in an experiment named Screen 5, p73 is electroporated into competent cells harboring p74, while in Screen 6 the inverse is true. Cultures were electroporated, recovered, titered, and grown under selective conditions as above for a single round, and plasmid recovery followed by amplification, NGS, and enrichment calculation were also performed as above.

Finally, additional CcdB selections were performed in a similar manner, but with guide scaffold 235 and with alternative promoters WGAN45, Ran2, and Ran4, all targeting the toxic CcdB plasmid with spacer 23.2. These promoters are expected to more weakly express the guide RNA compared to the above CcdB selections and are thus expected to reduce the total concentration of CasX RNP in a bacterial cell. This physiological effect should reduce the overall survival of bacterial cells in the selective assay, thus increasing the dynamic range of enrichment scores and correlating more precisely with RNP nuclease activity at the TTC PAM spacer 23.2. For each promoter, three rounds of selection were performed in triplicate as above, and each round of experimentation resulted in enrichment data as above. These experiments are hereafter referred to as Screen 7.

Results:

The results portrayed in FIG. 32 demonstrate that CasX 515 complexed with guide scaffold 174 is capable of cleaving the CcdB expression plasmid when targeted using spacers (listed below) that target DNA sequences associated with TTC PAM sequences. In contrast, spacers utilizing alternative PAM sequences exhibited far more variable survival. ATC PAM spacers (listed below) ranged in survival from a few percent to much less than 0.1%, while CTC PAM spacers (listed below) enabled survival in a range from >50% to less than 1%. Finally, GTC PAM spacers (listed below) only enabled survival at or below 0.1%. These benchmarking data support the experimental design of this selection pipeline and demonstrate the robust selective power of the CcdB bacterial assay. Specifically, CasX proteins unable to cleave double-stranded DNA are de-enriched by at least four orders of magnitude, while CasX proteins biochemically competent for cleavage will survive the assay.

The heatmaps of FIG. 33 were used to identify the set of variants of CasX 515 that are biochemically competent for dsDNA cleavage at target DNA sequences associated with a TTC PAM sequence, the heatmaps of FIG. 34 and FIG. 35 were used to identify those variants exhibiting improved for dsDNA cleavage at target DNA sequences associated with PAM sequences of CTC (spacers 11.2 and 23.27), while the heatmaps of FIG. 36 were generated from the same set of variants for a spacer associated with PAM sequences of ATC (spacer (23.19).

The results of FIGS. 33A-E identify and categorize variants of CasX 515 competent for editing at three TTC PAM target sites. These three datasets, either individually, or combined, represent underlying biochemical differences between variants and identify regions of interest for future engineering of improved CasX therapeutics for human genome editing. As evidence for this, internal controls were included uniformly as part of the naïve library, such as the presence of a stop codon at each position throughout the protein. These stop codons were consistently observed to be lost throughout rounds of selection, consistent with the expectation that partially truncated CasX 515 should not enable dsDNA cleavage. Similarly, variants with a loss of activity reflected in the heatmap data were observed to have become depleted during the selection, and thus have a severe loss of fitness for double-stranded DNA cleavage in this assay. However, variants with an enrichment value of one or greater (and a corresponding $\log_2$ enrichment value of zero or greater) are, at minimum, neutral with respect to biochemical cleavage. Importantly, if one or more of the mutations identified in this specific subset of variants exhibit desirable properties for a therapeutic molecule, these mutations establish a structure-function relationship shown to be compatible with biochemical function. More specifically, these mutations can affect properties such as CasX protein transcription, translation, folding, stability, ribonucleoprotein (RNP) formation, PAM recognition, double-stranded DNA unwinding, non-target strand cleavage, and target strand cleavage.

FIGS. 34A-E, FIGS. 35A-E, and FIGS. 36A-E were used to identify and categorize variants competent for cleavage at sequences associated with CTC and ATC PAM sequences. Enriched variants in these datasets (enrichment >1, equivalent to $\log_2$ enrichment for values of approximately 0) represent mutations that specifically improve cleavage of CTC or ATC PAM target sites. Mutations meeting these criteria can be further subcategorized in two general ways: either the mutation improves cleavage rates by improving the recognition of the PAM (Type 1) or the mutation improves the overall cleavage rate of the molecule regardless of the PAM sequence (Type 2).

As examples of the first type, substitution mutations at position 223 were found to be enriched by several hundredfold in all samples tested. This location encodes a glycine in both wild-type reference CasX proteins CasX 1 and 2, which is measured to be 6.34 angstroms from the −4 nucleotide position of the DNA non-target strand in the published CryoEM structure of CasX 1 (PDB ID: 6NY2). These substitution mutations at position 223 are thus physically proximal to the altered nucleotide of the novel PAM, and likely interact directly with the DNA. Further supporting this conclusion, many of the enriched substitutions encoded amino acids which are capable of forming additional hydrogen bonds relative to the replaced amino acid (glycine). These findings demonstrate that improved recognition of novel PAM sequences can be achieved in the CasX protein by introducing mutations that interact with one or both of the DNA strands, especially when physically proximal to the PAM DNA sequence (within ten angstroms). Additional features of the heatmaps in FIGS. 34-36 may represent mutations enabling increased recognition of non-canonical PAM sequences, but their mechanism of action has not yet been investigated.

As examples for the second type of mutation, the results of FIGS. 34A-E, 35A-E and 36A-E heatmaps were used to identify mutations that improve the overall cleavage rate compared to CasX 515, but without necessarily specifically recognizing the PAM sequence of the DNA. For example, a variant of CasX 515 consisting of an insertion of arginine at position 27 was measured to have an enrichment value greater than one in the selection with spacer 11.2 (CTC PAM) and spacer 23.19 (ATC PAM). This variant had previously been identified by a comparable selection on a CTC PAM spacer, where this mutation was enriched by orders of magnitude (data not shown). The position of this amino acid mutation is physically proximal (9.29 angstroms) to the DNA target strand at position −1 in the above structural model. These insights suggest a mechanism where the mature R-loop formed by CasX RNP with double-stranded DNA is stabilized by the side chain of the arginine, perhaps by ionic interactions of the positively charged side chain with the negatively charged backbone of the DNA target strand. Such an interaction is beneficial to overall cleavage kinetics without altering the PAM specificity. These data support the conclusion that some enriched mutations shown in FIGS. 34A-E, 35A-E and 36A-E represent variants that improve the overall cleavage activity of CasX 515 by physically interacting with either or both of the DNA strands when physically proximal to them (within ten angstroms).

The data support the conclusion that many of the mutations measured to improve cleavage at sequences associated with the CTC or ATC PAM sequences identified from the heatmaps in FIGS. 34A-E, 35A-E and 36A-E can be classified as either of the two types of mutations specified above. For mutations of type one, variants consisting of mutations to position 223 with a large enrichment score in at least one of the spacers tested at CTC PAMs are listed in Table 21, with the associated maximum enrichment score. For mutations of type two, a smaller list of mutations was chosen systematically from among the thousands of enriched variants. To identify those mutations highly likely to improve the overall cleavage activity compared to CasX 515, the following approach was taken. First, mutations were filtered for those which were most consistently enriched across CTC or ATM PAM spacers. A lower bound (LB) was defined for the enrichment score of each mutation for each spacer. LB was defined as the combined log$_2$ enrichment score across biological triplicates, minus the standard deviation of the log$_2$ enrichment scores for the individual replicates. Second, the subset of these mutations was taken in which LB>1 for at least two out of three independent experimental datasets (one ATC PAM selection and two CTC PAM selections). Third, this subset of mutations was further reduced by excluding those for which a negative log$_2$ enrichment was measured in any of the three TTC PAM selections. Finally, individual mutations were manually selected based on a combination of structural features and strong enrichment score in at least one experiment. The resulting 274 mutations meeting these criteria are listed in Table 22, along with the maximum observed log$_2$ enrichment score from the two CTC or one ATC PAM experiments represented in the heatmaps of FIGS. 34A-E, 35A-E and 36A-E, as well as the domain in which the mutation is located.

In contrast to Class I mutations, there exists another category of mutations that improve the ability of the CasX RNP to discriminate between on-target and off-target sites in genomic DNA, as determined by the spacer sequence, termed Class II, which improve the spacer specificity of the nuclease activity of the CasX protein. Two additional experiments were performed to specifically identify Class II mutations, where these experiments consisted of plasmid counter-selections and resulted in enrichment scores representing the sensitivity of the generated variant, compared to CasX 515, to a single mismatch between the spacer sequence of the guide RNA and the intended target DNA. The resulting enrichment scores were ranked for all observed mutations across the experimental data, and the following analyses were performed to identify a subset of mutations likely to improve the spacer specificity of the CasX protein without substantially reducing the nuclease activity at the desired on-target site. First, mutations from Screen 5 were ranked by their average enrichment score across three technical replicates using Spacer 23.2. Those mutations which were physically proximal to the nucleotide mismatch, as inferred from published models of the CasX RNP bound to a target site (PDB ID: 6NY2), were removed in order to discard those Class II mutations that might only confer improvements to specificity at Spacer 23.2 only, rather than universally across spacers. Finally, these Class II mutations were discarded if their cleavage activity at on-target TTC PAM sites was negatively impacted by the mutation if their average log 2 enrichment from the three TTC PAM CcdB selections was less than zero. The resulting mutations meeting these criteria are listed in Table 23, along with the maximum observed log$_2$ enrichment score from Screen 5 and the domain in which the mutation is located. Additionally, Class II mutations were identified from the counter-selection experiment Screen 6. These mutations were similarly ranked by their mean enrichment scores, but different filtering steps were applied. In particular, mutations were identified from each of the following categories: those with the highest mean enrichment scores from either Spacer 23.2, Spacer 23.11, or Spacer 23.13; those with the highest combined mean enrichment scores from Spacer 23.2 and Spacer 23.11; those with the highest combined mean enrichment scores from Spacer 23.11 and Spacer 23.13; or those with the highest combined mean enrichment scores from Spacer 23.2 in Screen 5 and Spacer 23.2 in Screen 6. These resulting mutations are listed in Table 23, along with the maximum observed log 2 enrichment score from Screen 6 and the domain in which the mutation is located.

In addition to the Class I or Class II mutations, there exists another category of mutations that has been directly observed to improve the dsDNA editing activity at TTC PAM sequences. These mutations, termed Class III mutations, demonstrated improved nuclease activity by way of exhibiting enrichment scores above that of CasX 515 when targeting the CcdB plasmid using Spacer 23.2 in Screen 7. A computational filtering step was used to identify a subset of these enriched mutations which are of particular interest. Specifically, mutations were identified that had an average enrichment value across three replicates that was greater than zero for each of the three promoters tested. Finally, features of the enrichment scores across the amino acid sequence were used to identify additional mutations at enriched positions. Example features of interest included the following: insertions or deletions at the junction of protein domains in order to facilitate topological changes; substitutions of an amino acid for proline in order to kink the polypeptide backbone; substitutions of an amino acid for a positively charged amino acid in order to add ionic bonding between the protein and the negatively charged nucleic acid backbone of either the guide RNA or either strand of the target DNA; deletions of an amino acid where consecutive deletions are both highly enriched; substitutions to a position that contains many highly enriched substitutions; substitutions of an amino acid for a highly enriched amino acid at the extreme N-terminus of the protein. These resulting mutations are listed in Table 24, along with the maximum observed log 2 enrichment score from Screen 6 and the domain in which the mutation is located.

TABLE 21

Mutations to CasX 515 (SEQ ID NO: 416) that improve cleavage activity at CTC PAM sequences by physically interacting with the PAM nucleotides of the DNA

| Position | Reference | Alternate | Maximum observed log$_2$ enrichment in Ccdb selections | Domain |
|---|---|---|---|---|
| 223 | G | Y | 4.6 | helical I-II |
| 223 | G | N | 5.7 | helical I-II |
| 223 | G | H | 4.2 | helical I-II |
| 223 | G | S | 4.6 | helical I-II |
| 223 | G | T | 3.8 | helical I-II |
| 223 | G | A | 6.3 | helical I-II |
| 223 | G | V | 3.6 | helical I-II |

TABLE 22

Mutations to CasX 515 (SEQ ID NO: 416) systematically identified from all datasets to improve cleavage activity at ATC and CTC PAM sequences

| Position | Reference | Alternate | Maximum observed log$_2$ enrichment in CcdB selections | Domain |
|---|---|---|---|---|
| 3 | — | G | 3.0 | OBD-I |
| 3 | I | G | 3.5 | OBD-I |
| 3 | I | E | 4.5 | OBD-I |
| 4 | — | G | 2.5 | OBD-I |
| 4 | K | G | 2.5 | OBD-I |
| 4 | K | P | 3.1 | OBD-I |
| 4 | K | S | 3.3 | OBD-I |

TABLE 22-continued

Mutations to CasX 515 (SEQ ID NO: 416) systematically identified from all datasets to improve cleavage activity at ATC and CTC PAM sequences

| Position | Reference | Alternate | Maximum observed log$_2$ enrichment in CcdB selections | Domain |
| --- | --- | --- | --- | --- |
| 4 | K | W | 2.8 | OBD-I |
| 5 | — | P | 3.5 | OBD-I |
| 5 | — | G | 3.1 | OBD-I |
| 5 | R | S | 3.7 | OBD-I |
| 5 | — | S | 2.2 | OBD-I |
| 5 | R | A | 3.2 | OBD-I |
| 5 | R | P | 3.6 | OBD-I |
| 5 | R | G | 3.2 | OBD-I |
| 5 | R | L | 2.7 | OBD-I |
| 6 | I | A | 3.3 | OBD-I |
| 6 | — | G | 3.7 | OBD-I |
| 7 | N | Q | 3.1 | OBD-I |
| 7 | N | L | 2.7 | OBD-I |
| 7 | N | S | 3.7 | OBD-I |
| 8 | K | G | 3.3 | OBD-I |
| 15 | K | F | 3.0 | OBD-I |
| 16 | D | W | 2.8 | OBD-I |
| 16 | — | F | 4.2 | OBD-I |
| 18 | — | F | 3.5 | OBD-I |
| 28 | M | H | 2.5 | OBD-I |
| 33 | V | T | 2.0 | OBD-I |
| 34 | R | P | 3.6 | OBD-I |
| 36 | M | Y | 2.4 | OBD-I |
| 41 | R | P | 2.2 | OBD-I |
| 47 | L | P | 2.2 | OBD-I |
| 52 | E | P | 3.2 | OBD-I |
| 55 | — | P | 2.7 | OBD-I |
| 55 | PQ | — | 3.0 | OBD-I |
| 56 | Q | S | 1.9 | OBD-I |
| 56 | — | D | 2.5 | OBD-I |
| 56 | — | T | 2.8 | OBD-I |
| 56 | Q | P | 3.9 | OBD-I |
| 58 | — | A | 2.2 | helical I-I |
| 63 | R | S | 3.0 | helical I-I |
| 63 | R | Q | 2.7 | helical I-I |
| 72 | D | E | 2.7 | helical I-I |
| 81 | L | V | 2.8 | helical I-I |
| 81 | L | T | 2.7 | helical I-I |
| 85 | W | G | 3.2 | helical I-I |
| 85 | W | F | 2.7 | helical I-I |
| 85 | W | E | 2.9 | helical I-I |
| 85 | W | D | 3.1 | helical I-I |
| 85 | W | A | 2.8 | helical I-I |
| 85 | W | Q | 3.0 | helical I-I |
| 85 | W | R | 3.7 | helical I-I |
| 88 | F | M | 2.4 | helical I-I |
| 89 | Q | D | 2.5 | helical I-I |
| 93 | V | L | 1.9 | helical I-I |
| 109 | Q | P | 1.8 | NTSB |
| 115 | E | S | 1.8 | NTSB |
| 120 | G | D | 2.4 | NTSB |
| 133 | G | T | 2.2 | NTSB |
| 141 | L | A | 2.2 | NTSB |
| 168 | L | K | 3.1 | NTSB |
| 170 | A | Y | 2.7 | NTSB |
| 170 | A | S | 1.7 | NTSB |
| 175 | E | A | 2.0 | NTSB |
| 175 | E | D | 2.8 | NTSB |
| 175 | E | P | 3.8 | NTSB |
| 223 | G | — | 1.4 | helical I-II |
| 223 | G | S | 8.8 | helical I-II |
| 223 | G | T | 3.7 | helical I-II |
| 242 | S | T | 1.9 | helical I-II |
| 247 | I | T | 1.8 | helical I-II |
| 254 | V | T | 2.5 | helical I-II |
| 265 | L | Y | 1.9 | helical I-II |
| 288 | K | G | 4.2 | helical I-II |
| 288 | K | S | 4.0 | helical I-II |
| 291 | V | L | 2.6 | helical I-II |
| 303 | M | T | 2.3 | helical I-II |
| 303 | M | W | 2.7 | helical I-II |
| 328 | G | N | 3.3 | helical I-II |
| 331 | S | Q | 2.7 | helical I-II |
| 334 | — | A | 2.3 | helical II |
| 334 | LV | — | 3.0 | helical II |
| 335 | V | E | 2.8 | helical II |
| 335 | V | Q | 2.7 | helical II |
| 335 | V | F | 2.5 | helical II |
| 335 | V | — | 3.2 | helical II |
| 336 | E | P | 2.9 | helical II |
| 336 | E | — | 3.1 | helical II |
| 336 | E | D | 2.7 | helical II |
| 336 | E | L | 2.4 | helical II |
| 336 | E | R | 2.7 | helical II |
| 337 | R | N | 2.5 | helical II |
| 338 | Q | V | 2.5 | helical II |
| 338 | — | Q | 3.0 | helical II |
| 339 | — | G | 2.6 | helical II |
| 341 | — | H | 2.9 | helical II |
| 341 | — | A | 2.0 | helical II |
| 342 | V | D | 2.7 | helical II |
| 342 | — | T | 2.3 | helical II |
| 342 | V | — | 3.0 | helical II |
| 342 | — | F | 2.5 | helical II |
| 343 | — | D | 3.3 | helical II |
| 343 | D | — | 2.0 | helical II |
| 344 | W | — | 3.1 | helical II |
| 344 | W | T | 2.8 | helical II |
| 344 | W | H | 2.8 | helical II |
| 344 | — | P | 3.0 | helical II |
| 344 | — | G | 2.6 | helical II |
| 345 | — | R | 3.2 | helical II |
| 345 | W | P | 3.1 | helical II |
| 345 | W | D | 2.3 | helical II |
| 345 | — | D | 2.9 | helical II |
| 345 | W | L | 2.3 | helical II |
| 346 | — | P | 2.4 | helical II |
| 346 | — | D | 2.9 | helical II |
| 347 | M | — | 2.6 | helical II |
| 348 | — | T | 3.3 | helical II |
| 350 | N | I | 2.3 | helical II |
| 351 | V | N | 2.8 | helical II |
| 351 | V | H | 3.1 | helical II |
| 352 | K | D | 2.2 | helical II |
| 354 | L | D | 3.1 | helical II |
| 355 | I | S | 2.6 | helical II |
| 357 | E | C | 2.1 | helical II |
| 357 | E | P | 2.8 | helical II |
| 358 | K | T | 2.8 | helical II |
| 359 | K | E | 2.7 | helical II |
| 363 | K | L | 3.3 | helical II |
| 363 | K | Y | 2.2 | helical II |
| 367 | Q | D | 2.8 | helical II |
| 367 | Q | P | 3.0 | helical II |
| 369 | — | S | 2.6 | helical II |
| 369 | LA | — | 2.4 | helical II |
| 373 | K | L | 2.2 | helical II |
| 374 | — | R | 2.0 | helical II |
| 397 | Y | T | 2.5 | helical II |
| 400 | G | M | 2.0 | helical II |
| 402 | L | V | 2.4 | helical II |
| 403 | L | C | 2.3 | helical II |
| 404 | L | D | 2.5 | helical II |
| 404 | L | N | 2.5 | helical II |
| 404 | L | W | 2.3 | helical II |
| 404 | L | Y | 2.1 | helical II |
| 407 | E | F | 2.6 | helical II |
| 407 | E | L | 2.2 | helical II |
| 407 | E | Y | 2.6 | helical II |
| 411 | G | P | 2.6 | helical II |
| 411 | — | E | 3.2 | helical II |
| 413 | — | T | 2.7 | helical II |
| 413 | — | R | 2.4 | helical II |
| 413 | — | W | 3.0 | helical II |

TABLE 22-continued

Mutations to CasX 515 (SEQ ID NO: 416) systematically identified from all datasets to improve cleavage activity at ATC and CTC PAM sequences

| Position | Reference | Alternate | Maximum observed log₂ enrichment in CcdB selections | Domain |
|---|---|---|---|---|
| 413 | — | Y | 3.7 | helical II |
| 414 | — | W | 2.6 | helical II |
| 414 | — | Y | 3.1 | helical II |
| 414 | W | G | 3.0 | helical II |
| 414 | W | R | 2.6 | helical II |
| 416 | K | D | 2.7 | helical II |
| 416 | K | H | 2.0 | helical II |
| 416 | K | P | 2.6 | helical II |
| 416 | K | T | 2.3 | helical II |
| 417 | V | L | 2.6 | helical II |
| 417 | V | A | 2.5 | helical II |
| 418 | Y | C | 2.7 | helical II |
| 419 | D | G | 3.2 | helical II |
| 419 | D | M | 2.4 | helical II |
| 419 | D | P | 2.4 | helical II |
| 425 | I | C | 2.2 | helical II |
| 427 | K | T | 2.4 | helical II |
| 428 | K | R | 2.5 | helical II |
| 430 | E | G | 1.9 | helical II |
| 432 | L | A | 1.9 | helical II |
| 434 | K | H | 2.2 | helical II |
| 436 | I | T | 2.4 | helical II |
| 436 | I | S | 3.0 | helical II |
| 436 | I | Q | 2.7 | helical II |
| 437 | K | D | 3.1 | helical II |
| 442 | R | D | 2.5 | helical II |
| 442 | R | — | 2.7 | helical II |
| 446 | D | E | 2.3 | helical II |
| 446 | — | D | 2.3 | helical II |
| 450 | K | P | 2.3 | helical II |
| 452 | A | R | 2.0 | helical II |
| 453 | L | T | 3.2 | helical II |
| 456 | W | L | 2.2 | helical II |
| 457 | L | C | 2.2 | helical II |
| 459 | A | L | 2.0 | helical II |
| 461 | A | T | 2.7 | helical II |
| 461 | A | K | 2.1 | helical II |
| 465 | I | E | 3.1 | helical II |
| 465 | — | C | 2.9 | helical II |
| 466 | — | S | 3.5 | helical II |
| 466 | — | G | 2.5 | helical II |
| 467 | — | R | 2.4 | helical II |
| 467 | G | P | 2.0 | helical II |
| 468 | L | K | 3.6 | helical II |
| 468 | L | D | 3.2 | helical II |
| 468 | L | S | 3.0 | helical II |
| 468 | L | H | 3.3 | helical II |
| 470 | E | — | 2.4 | helical II |
| 472 | D | R | 2.2 | helical II |
| 472 | — | D | 2.4 | helical II |
| 473 | — | P | 2.6 | helical II |
| 474 | — | D | 2.7 | helical II |
| 475 | EF | — | 2.8 | helical II |
| 475 | — | Q | 2.7 | helical II |
| 476 | F | K | 2.8 | helical II |
| 476 | F | — | 2.2 | helical II |
| 477 | — | G | 2.8 | helical II |
| 479 | C | D | 3.1 | helical II |
| 480 | — | V | 2.2 | helical II |
| 480 | E | D | 2.3 | helical II |
| 481 | — | H | 2.2 | helical II |
| 481 | L | R | 2.9 | helical II |
| 482 | K | R | 2.1 | helical II |
| 483 | L | H | 2.7 | helical II |
| 484 | Q | C | 2.1 | helical II |
| 485 | K | P | 3.0 | helical II |
| 490 | L | S | 2.8 | helical II |
| 498 | E | L | 2.1 | helical II |
| 499 | — | F | 1.6 | helical II |
| 511 | K | T | 6.8 | OBD-II |
| 524 | — | P | 2.4 | OBD-II |
| 553 | — | S | 2.4 | OBD-II |
| 558 | — | R | 1.9 | OBD-II |
| 570 | M | T | 2.7 | OBD-II |
| 582 | I | T | 1.9 | OBD-II |
| 592 | Q | I | 2.1 | OBD-II |
| 592 | Q | F | 2.8 | OBD-II |
| 592 | Q | V | 2.0 | OBD-II |
| 592 | Q | A | 2.9 | OBD-II |
| 641 | — | R | 2.3 | OBD-II |
| 643 | — | D | 2.7 | OBD-II |
| 644 | — | W | 2.5 | OBD-II |
| 645 | — | A | 2.4 | OBD-II |
| 650 | — | I | 2.5 | RuvC-I |
| 651 | — | S | 2.4 | RuvC-I |
| 652 | — | T | 2.4 | RuvC-I |
| 652 | — | N | 2.3 | RuvC-I |
| 653 | — | R | 2.3 | RuvC-I |
| 653 | — | K | 2.2 | RuvC-I |
| 654 | — | H | 2.2 | RuvC-I |
| 654 | — | S | 2.3 | RuvC-I |
| 658 | V | L | 1.9 | RuvC-I |
| 695 | G | W | 1.4 | RuvC-I |
| 695 | G | R | 3.5 | RuvC-I |
| 708 | K | S | 3.0 | RuvC-I |
| 708 | K | T | 2.9 | RuvC-I |
| 708 | K | E | 3.1 | RuvC-I |
| 711 | V | A | 1.6 | RuvC-I |
| 726 | K | E | 2.0 | RuvC-I |
| 729 | N | G | 2.8 | RuvC-I |
| 736 | R | H | 2.7 | RuvC-I |
| 736 | R | G | 2.4 | RuvC-I |
| 771 | M | S | 3.7 | RuvC-I |
| 771 | M | A | 3.3 | RuvC-I |
| 792 | L | F | 2.5 | RuvC-I |
| 868 | V | D | 1.9 | TSL |
| 877 | — | A | 2.0 | TSL |
| 886 | T | E | 1.8 | TSL |
| 886 | T | D | 2.5 | TSL |
| 886 | T | N | 1.6 | TSL |
| 888 | G | D | 2.5 | TSL |
| 890 | S | — | 3.0 | TSL |
| 891 | G | — | 2.7 | TSL |
| 892 | — | E | 2.0 | TSL |
| 892 | — | N | 2.9 | TSL |
| 895 | S | I | 1.7 | TSL |
| 908 | E | D | 1.7 | TSL |
| 932 | S | M | 2.5 | RuvC-II |
| 932 | S | V | 2.6 | RuvC-II |
| 944 | — | L | 1.4 | RuvC-II |
| 947 | — | G | 1.9 | RuvC-II |
| 949 | T | — | 1.9 | RuvC-II |
| 951 | G | I | 3.7 | RuvC-II |

TABLE 23

Mutations to CasX 515 (SEQ ID NO: 416) systematically identified from all datasets to improve spacer specificity

| Position | Reference | Alternate | Maximum observed log₂ enrichment in counter-selections | Domain |
|---|---|---|---|---|
| 6 | I | L | 2.25 | OBD-I |
| 48 | — | P | 2 | OBD-I |
| 87 | — | G | 3.96 | helical I-I |
| 90 | K | V | 4.84 | helical I-I |
| 155 | F | V | 2.13 | NTSB |
| 215 | — | T | 2.03 | helical I-II |
| 216 | — | C | 3.03 | helical I-II |
| 220 | Y | F | 2.1 | helical I-II |

TABLE 23-continued

Mutations to CasX 515 (SEQ ID NO: 416) systematically identified from all datasets to improve spacer specificity

| Position | Reference | Alternate | Maximum observed log₂ enrichment in counter-selections | Domain |
|---|---|---|---|---|
| 264 | S | H | 3.16 | helical I-II |
| 329 | — | Q | 2.71 | helical I-II |
| 343 | D | S | 2.69 | helical II |
| 346 | DM | — | 2.96 | helical II |
| 349 | — | P | 2.06 | helical II |
| 357 | — | G | 2.11 | helical II |
| 375 | QE | — | 2.34 | helical II |
| 378 | L | N | 2.38 | helical II |
| 389 | K | Q | 2.29 | helical II |
| 417 | — | L | 2.75 | helical II |
| 441 | E | L | 2.36 | helical II |
| 458 | R | D | 2.2 | helical II |
| 459 | A | E | 2.65 | helical II |
| 476 | FC | — | 2.34 | helical II |
| 503 | IL | — | 2.15 | OBD-II |
| 537 | K | G | 2.85 | OBD-II |
| 621 | L | T | 2.45 | OBD-II |
| 624 | — | A | 3 | OBD-II |
| 783 | L | Y | 2.08 | RuvC-I |
| 783 | — | P | 2.6 | RuvC-I |
| 787 | L | — | 2.49 | RuvC-I |
| 787 | L | R | 3.58 | RuvC-I |
| 787 | L | D | 5.58 | RuvC-I |
| 788 | — | Q | 2.65 | RuvC-I |
| 789 | — | R | 2.5 | RuvC-I |
| 789 | — | N | 2.71 | RuvC-I |
| 790 | E | N | 2.45 | RuvC-I |
| 792 | — | P | 2.85 | RuvC-I |
| 793 | P | A | 2.93 | RuvC-I |
| 795 | K | Q | 2.45 | RuvC-I |
| 796 | T | V | 2.75 | RuvC-I |
| 798 | — | R | 4.07 | RuvC-I |
| 799 | — | H | 2.79 | RuvC-I |
| 801 | T | Q | 3.16 | RuvC-I |
| 801 | — | H | 3.34 | RuvC-I |
| 801 | — | R | 2.86 | RuvC-I |
| 802 | — | L | 2.88 | RuvC-I |
| 802 | L | — | 2.87 | RuvC-I |
| 802 | — | W | 3.08 | RuvC-I |
| 803 | — | A | 3.19 | RuvC-I |
| 803 | — | F | 3.14 | RuvC-I |
| 803 | A | S | 5.79 | RuvC-I |
| 804 | Q | K | 3.05 | RuvC-I |
| 805 | Y | — | 3.29 | RuvC-I |
| 806 | T | Y | 3.07 | RuvC-I |
| 806 | T | F | 2.49 | RuvC-I |
| 807 | — | I | 3.21 | RuvC-I |
| 807 | S | P | 2.61 | RuvC-I |
| 809 | T | P | 3.2 | RuvC-I |
| 809 | — | N | 3.1 | RuvC-I |
| 810 | C | K | 3.19 | RuvC-I |
| 810 | C | M | 3.08 | RuvC-I |
| 811 | — | M | 2.51 | TSL |
| 812 | N | — | 3.07 | TSL |
| 812 | — | V | 2.68 | TSL |
| 813 | C | S | 2.3 | TSL |
| 814 | — | G | 3.15 | TSL |
| 814 | — | W | 3.04 | TSL |
| 815 | F | P | 3.09 | TSL |
| 817 | — | W | 2.87 | TSL |
| 828 | K | G | 1.99 | TSL |
| 906 | V | C | 2.01 | TSL |

TABLE 24

Mutations to CasX 515 (SEQ ID NO: 416) systematically identified from all datasets to improve cleavage activity at TTC PAM sequences

| Position | Reference | Alternate | Maximum observed log₂ enrichment in Ccdb selections | Domain |
|---|---|---|---|---|
| 4 | K | W | 3.51 | OBD-I |
| 5 | R | P | 4.01 | OBD-I |
| 27 | — | P | 4.69 | OBD-I |
| 28 | M | P | 3.69 | OBD-I |
| 56 | Q | P | 3.78 | OBD-I |
| 85 | W | A | 3.96 | helical I-I |
| 102 | — | G | 4.75 | NTSB |
| 104 | — | I | 4.43 | NTSB |
| 104 | — | L | 4.52 | NTSB |
| 130 | S | — | 4.02 | NTSB |
| 151 | Y | T | 3.46 | NTSB |
| 168 | L | D | 3.32 | NTSB |
| 168 | L | E | 4.08 | NTSB |
| 188 | K | Q | 4.96 | NTSB |
| 190 | G | Q | 4.1 | NTSB |
| 223 | G | — | 1.63 | helical I-II |
| 235 | G | L | 4.64 | helical I-II |
| 235 | G | H | 4.97 | helical I-II |
| 239 | S | H | 3.93 | helical I-II |
| 239 | S | T | 4.97 | helical I-II |
| 245 | Q | H | 5 | helical I-II |
| 288 | K | D | 5.08 | helical I-II |
| 288 | K | E | 4.79 | helical I-II |
| 303 | M | R | 3.71 | helical I-II |
| 303 | M | K | 3.29 | helical I-II |
| 307 | L | K | 3.55 | helical I-II |
| 328 | G | R | 3.91 | helical I-II |
| 328 | G | K | 4.58 | helical I-II |
| 334 | — | H | 5.65 | helical II |
| 335 | — | D | 5.5 | helical II |
| 335 | V | P | 5.1 | helical II |
| 345 | — | Q | 5.22 | helical II |
| 441 | — | K | 5.07 | helical II |
| 477 | C | R | 2.94 | helical II |
| 477 | C | K | 3.49 | helical II |
| 502 | S | — | 4.04 | OBD-II |
| 503 | I | R | 3.72 | OBD-II |
| 503 | I | K | Not detected | OBD-II |
| 504 | L | — | 4.24 | OBD-II |
| 542 | R | E | 4.54 | OBD-II |
| 563 | K | — | 3.25 | OBD-II |
| 593 | — | A | 1.83 | OBD-II |
| 610 | K | Q | 3.46 | OBD-II |
| 615 | R | Q | 3.67 | OBD-II |
| 643 | — | A | 2.42 | OBD-II |
| 697 | S | R | 2.67 | RuvC-I |
| 697 | S | K | 2.55 | RuvC-I |
| 906 | V | T | 4.65 | TSL |

Example 15: Evaluation of Spacer Length on Editing in Cells when Delivered as RNP The purpose of the experiment was to determine the effect of spacer (targeting sequence) length on editing a target nucleic acid by RNPs of CasX and guides delivered intracellularly.

CasX variant 491 was purified as described above. Guide RNAs with scaffold 174 were prepared by in vitro transcription (IVT). IVT templates were generated by PCR using Q5 polymerase (NEB M0491) according to the recommended protocol, template oligos for each scaffold backbone, and amplification primers with the T7 promoter and either the 15.3 (CAAACAAATGTGTCACAAAG, SEQ ID NO: 165) or 15.5 (GGAATAATGCTGTTGTTGAA, SEQ ID NO: 166) spacer at full-length (20 nucleotides) or truncated by one or two nucleotides from the 3' end of the respective spacer (sequences in Table 26). The sequences of the primers used to generate the IVT templates are shown in Table 25. The resulting templates were then used with T7 RNA polymerase to produce RNA guides according to standard protocols. The guides were purified using denaturing polyacrylamide gel electrophoresis and refolded prior to use. Individual RNPs were assembled by mixing protein with a 1.2-fold molar excess of guide in buffer containing 25 mM sodium phosphate buffer (pH 7.25), 300 mM NaCl, 1 mM MgCl2, and 200 mM trehalose. RNPs were incubated at 37° C. for 10 minutes and then purified via size exclusion chromatography and exchanged into buffer containing 25 mM sodium phosphate buffer (pH 7.25), 150 mM NaCl, 1 mM MgCl2, and 200 mM trehalose (Buffer 1). The concentration of the RNP was determined following purification using the Pierce 660 nm protein assay.

Purified RNPs were tested for editing at the T Cell Receptor α (TCRα) locus in Jurkat cells. RNPs were delivered by electroporation using the Lonza 4-D nucleofector system. 700,000 cells were resuspended in 20 μL of Lonza buffer SE and added to RNP diluted in Buffer 1 to the appropriate concentration and a final volume of 2 pt. Cells were electroporated using the Lonza 96-well shuttle system using the protocol CL-120. Cells were recovered at 37° C. in pre-equilibrated RPMI and then each electroporation condition was split into three wells of a 96-well plate. Cells were exchanged into fresh RPMI one day after nucleofection. On day three post-nucleofection, cells were stained with Alexa Fluor 647-labeled antibody against TCRα/β (BioLegend) and assessed for loss of surface TCRα/β using an Attune Nxt flow cytometer. A fraction of Jurkat cells does not stain positive for TCRα/β in the absence of editing. To account for this and estimate the actual percentage of cells that had TCRα knocked out via editing, the formula $TCR_{KO}=(TCR_{obs}-TCR_{neg})/(1-TCR_{neg})$ was applied, where $TCR_{KO}$ is the estimated knockout rate of TCRα, $TCR_{obs}$ is the observed fraction of cells negative for TCR staining in the experimental sample, and TCR-neg is the fraction of cells negative for TCR staining in the no RNP control sample. This formula assumes that cells that do and do not express TCRα/β are edited at equal rates. The corrected fraction of TCRα knockout cells were plotted against the concentration of RNP using Prism. For each spacer, the three spacer lengths were fit with dose response curves using shared parameters except for the EC50. The reported p-values are the probability that the dose curve for the 20-nt spacer and that of the compared truncated spacer can be modeled with the same EC50 parameter.

TABLE 25

Oligonucleotides used to generate IVT templates

| Construct | DNA sequence |
| --- | --- |
| Scaffold 174 template fwd | GAAATTAATACGACTCACTATAACTGGCGCTTTTATCTGATTACTTTGAGAGCCATCACCAGCGACTATGTCGTAGTGGGTAAAGCT (SEQ ID NO: 1088) |
| Scaffold 174 template rev | CTTTGATGCTCCCTCCGAAGAGGGAGCTTTACCCACTACGACATAGTCGC (SEQ ID NO: 1089) |
| T7 amplification primer | GAAATTAATACGACTCACTATA (SEQ ID NO: 169) |
| 15.3 20-nt spacer primer | CTTTGTGACACATTTGTTTGCTTTGATGCTCCCTCC (SEQ ID NO: 1093) |
| 15.3 19-nt spacer primer | TTTGTGACACATTTGTTTGCTTTGATGCTCCCTCC (SEQ ID NO: 1094) |
| 15.3 18-nt spacer primer | TTGTGACACATTTGTTTGCTTTGATGCTCCCTCC (SEQ ID NO: 1095) |
| 15.5 20-nt spacer primer | TTCAACAACAGCATTATTCCCTTTGATGCTCCCTCC (SEQ ID NO: 1096) |
| 15.5 19-nt spacer primer | TCAACAACAGCATTATTCCCTTTGATGCTCCCTCC (SEQ ID NO: 1097) |
| 15.5 18-nt spacer primer | CAACAACAGCATTATTCCCTTTGATGCTCCCTCC (SEQ ID NO: 1098) |

TABLE 26

Spacer Sequences

| Construct | RNA sequence |
| --- | --- |
| 15.3 20-nt spacer | CAAACAAAUGUGUCACAAAG (SEQ ID NO: 1099) |
| 15.3 19-nt spacer | CAAACAAAUGUGUCACAAA (SEQ ID NO: 1100) |
| 15.3 18-nt spacer | CAAACAAAUGUGUCACAA (SEQ ID NO: 1101) |
| 15.5 20-nt spacer | GGAAUAAUGCUGUUGUUGAA (SEQ ID NO: 1102) |
| 15.5 19-nt spacer | GGAAUAAUGCUGUUGUUGA (SEQ ID NO: 1103) |
| 15.5 18-nt spacer | GGAAUAAUGCUGUUGUUG (SEQ ID NO: 1104) |

Results: CasX RNPs were assembled using CasX variant 491 and guides composed of scaffold 174 with either spacer 15.3 or 15.5, both of which target the constant region of the TCRα gene. Guides with full-length 20-nt spacers as well as truncated 19- and 18-nt spacers were tested to determine whether use of shorter spacers supported increased editing when pre-assembled RNPs are nucleofected for ex vivo editing. RNPs were tested at 2-fold dilutions ranging from 0.3125 μM to 2.5 μM in a 22 μL nucleofection reaction. Editing was assessed by flow cytometry three days after nucleofection. For both spacer sequences, the RNPs with truncated spacers largely edited more efficiently than those with 20-nt spacers across the dose range (FIGS. 37A-B, dose-response curves). For spacer 15.3, the 18-nt and 19-nt spacers had EC50 values of 0.225 μM and 0.299 μM, respectively, as compared to 1.414 μM for the 20-nt spacer (p<0.0001 for both truncations; extra-sum-of-squares F test). For spacer 15.5, the 18-nt spacer had an EC50 of 0.519 μM vs 0.938 μM for the 20-nt spacer (p=0.0001), while the 19-nt spacer was more similar to the 20-nt spacer, with an EC50 of 0.808 μM (p=0.0762). Despite the fact that the 19-nt 15.3 spacer had editing similar to the 18-nt spacer while the 19-nt 15.5 spacer more closely resembles the corresponding 20-nt spacer, for both spacers tested, however, the direction of the trend remained consistent and suggests that using guides with 18-nt spacers may be a generalizable strategy for increasing editing when the CasX editing molecule is delivered as a pre-assembled RNP, and demonstrates that shorter spacers of 18 or 19 support increased activity compared to a spacer of 20 bases in ex vivo editing by RNP.

Example 16: The Assay Identifies CasX Protein Variants with Novel PAM Sequence Specificity The purpose of the experiment was to identify the PAM sequence specificities of sequence variants of CasX protein 515 (SEQ ID NO: 416). To accomplish this, the HEK293 cell line PASS_V1.01 was treated with CasX protein 491 (SEQ ID NO:336) or 515 or a variant of 515, together with guide 174 (SEQ ID NO: 2238) and Next-generation sequencing (NGS) was performed to calculate the percent editing at a variety of spacers and associated target sites.

Materials and Methods: A multiplexed pooled approach was taken to assay clonal protein variants using the PASS system. Briefly, a pooled HEK cell line was generated and termed PASS_V1.01. Each cell within the pool contained a genome-integrated single-guide RNA (sgRNA), paired with a specific target site. After transfection of protein-expression constructs, editing at a specific target by a specific spacer could be quantified by NGS. Each guide-target pair was designed to provide data related to activity, specificity, and targetability of the CasX-guide RNP complex.

Paired spacer-target sequences were synthesized by Twist Biosciences and obtained as an equimolar pool of oligonucleotides. This pool was amplified by PCR and cloned by Golden Gate cloning to generate a final library of plasmids named p77. Each plasmid contained a sgRNA expression element and a target site, along with a GFP expression element. The sgRNA expression element consisted of a U6 promoter driving transcription of gRNA scaffold 174 (SEQ ID NO: 2238), followed by a spacer sequence which would target the RNP of the guide and CasX variant to the paired target site. 250 possible unique, paired spacer-target synthetic sequences were designed and synthesized. A pool of lentivirus was then produced from this plasmid library using the LentiX production system (Takara Bio USA, Inc) according to the manufacturer's instructions. The resulting viral preparation was then quantified by qPCR and transduced into a standard HEK293 cell line at a low multiplicity of infection so as to generate single copy integrations. The resulting cell line was then purified by fluorescence-activated cell sorting (FACS) to complete the production of PASS_V1.01. This cell line was then seeded in six-well plate format and treated in duplicate with either water or was transfected with 2 μg of plasmid p67, delivered by Lipofectamine™ Transfection Reagent (ThermoFisher) according to the manufacturer's instructions. Plasmid p67 contains an EF-1a promoter driving expression of a CasX protein tagged with the SV40 Nuclear Localization Sequence. After two days, treated PASS_V1.01 cells were collected, lysed, and genomic DNA was extracted using a genomic DNA isolation kit (Zymo Research). Genomic DNA was then PCR amplified with custom primers to generate amplicons compatible with Illumina NGS and sequenced on a NextSeq instrument. Sample reads were demultiplexed and filtered for quality. Editing outcome metrics (fraction of reads with indels) were then quantified for each spacer-target synthetic sequence across treated samples.

To assess the PAM sequence specificity for a molecule, editing outcome metrics for four different PAM sequences were categorized. For TTC PAM target sites, 48 different spacer-target pairs were quantified; for ATC, CTC, and GTC PAM target sites, 14, 22, and 11 individual target sites were quantified, respectively. The average editing efficiency and standard error of the mean for two biological replicates was calculated for each of these spacers. The average editing efficiency across the four categories of PAM sequence was also calculated, along with the standard error of the mean.

Results: Table 27 lists the average editing efficiency for the above described spacers when targeted with CasX protein variant 515, calculated as the mean of two experiments. The spacer name and associated PAM sequence are indicated. Table 28 lists the same data for CasX protein variant 534. Additionally, the average editing efficiency was calculated for each of the four categories of PAM sequence.

TABLE 27

Average editing of CasX 515 with spacers associated with PAM sequences of TTC, ATC, CTC, or GTC

| Spacer Name | TTC PAM Average Percent Editing | ATC PAM Average Percent Editing | CTC PAM Average Percent Editing | GTC PAM Average Percent Editing |
| --- | --- | --- | --- | --- |
| Rho_11.2 | 32.60 | 3.03 | 0.00 | 4.01 |
| Rho_11.24 | 44.61 | 0.49 | 2.55 | 0.13 |
| SOD1_8.89 | 18.29 | 0.00 | 0.00 | 0.00 |
| SOD1_8.57 | 25.65 | 6.34 | 9.01 | 2.52 |
| DMD_16.30 | 36.53 | 3.24 | 0.68 | 1.07 |
| DMD_16.32 | 33.76 | 1.20 | 0.01 | 2.21 |
| BCL11A_21.1 | 38.17 | 5.19 | 11.24 | 22.85 |
| PCSK9_6.8 | 28.94 | 5.48 | 9.84 | 2.35 |
| B2M_7.37 | 48.25 | 4.31 | 3.27 | 4.24 |
| CD70_26.3 | 23.89 | 1.71 | 4.96 | 0.33 |
| DMD_16.29 | 1.29 | — | — | — |
| DMD_16.31 | 21.69 | — | — | — |
| HTT_5.1 | 32.77 | — | — | — |
| DMPK_20.7 | 19.89 | — | — | — |
| B2M_7.9 | 42.44 | — | — | — |
| CD70_26.5 | 27.52 | — | — | — |
| FSHD_25.1 | 17.74 | — | — | — |
| PMP22_18.22 | 19.65 | — | — | — |
| PTBP1_28.1 | 4.00 | — | — | — |
| VCV000162497_alt | 11.40 | — | — | — |
| VCV000037426_alt | 7.00 | — | — | — |
| VCV000052759_alt | 13.14 | — | — | — |
| VCV000031157_alt | 0.00 | — | — | — |
| VCV000217157_alt | 17.94 | — | — | — |
| VCV000048146_alt | 18.05 | — | — | — |
| VCV000039614_alt | 33.14 | — | — | — |
| VCV000217646_alt | 37.75 | — | — | — |
| VCV000408199_alt | 27.21 | — | — | — |
| VCV000431973_alt | 16.05 | — | — | — |
| VCV000004193_alt | 2.85 | — | — | — |
| VCV000003920_alt | 34.92 | — | — | — |
| VCV000224616_alt | 36.90 | — | — | — |
| VCV000004787_alt | 34.83 | — | — | — |
| VCV000013115_alt | 26.04 | — | — | — |
| VCV000195355_alt | 32.05 | — | — | — |
| VCV000190123_alt | 36.17 | — | — | — |

TABLE 27-continued

Average editing of CasX 515 with spacers associated
with PAM sequences of TTC, ATC, CTC, or GTC

| Spacer Name | TTC PAM Average Percent Editing | ATC PAM Average Percent Editing | CTC PAM Average Percent Editing | GTC PAM Average Percent Editing |
|---|---|---|---|---|
| VCV000048535_alt | 21.74 | — | — | — |
| VCV000468648_alt | 49.12 | — | — | — |
| VCV000000908_alt | 32.78 | — | — | — |
| VCV000066016_alt | 20.45 | — | — | — |
| VCV000184702_alt | 14.97 | — | — | — |
| VCV000003825_alt | 27.40 | — | — | — |
| VCV000014243_alt | 32.03 | — | — | — |
| VCV000046102_alt | 41.95 | — | — | — |
| VCV000050962_alt | 47.92 | — | — | — |
| VCV000011908_alt | 38.86 | — | — | — |
| VCV000252575_alt | 24.77 | — | — | — |
| SOD1_G93A_alt | 22.54 | — | — | — |
| C9orf72_29.1 | — | 20.52 | — | — |
| VCV000092361_alt | — | 6.13 | — | — |
| VCV000096602_alt | — | 0.56 | — | — |
| DUX4_25.3_alt | — | 4.02 | — | — |
| VCV000012379_alt | — | — | 0.52 | — |
| VCV000067838_alt | — | — | 0.64 | — |
| VCV000246282_alt | — | — | 0.00 | — |
| VCV000000157_alt | — | — | 2.01 | — |
| VCV000550954_alt | — | — | 1.58 | — |
| VCV000189075_alt | — | — | 4.63 | — |
| VCV000006756_alt | — | — | 2.61 | — |
| VCV000100629_alt | — | — | 3.39 | — |
| VCV000372498_alt | — | — | 2.97 | — |
| VCV000002019_alt | — | — | 1.56 | — |
| HTT_slot_1_alt | — | — | 3.13 | — |
| HTT_slot_2_alt | — | — | 0.00 | — |
| HTT_slot_3_alt | — | — | — | 2.00 |

TABLE 28

Average editing of CasX 534 at spacers associated
with PAM sequences of TTC, ATC, CTC, or GTC

| Spacer Name | TTC PAM Average Percent Editing | ATC PAM Average Percent Editing | CTC PAM Average Percent Editing | GTC PAM Average Percent Editing |
|---|---|---|---|---|
| Rho_11.2 | 0.70 | 0.24 | 0.25 | 8.00 |
| Rho_11.24 | 2.49 | 3.16 | 5.29 | 11.50 |
| SOD1_8.89 | 0.06 | 0.04 | 0.00 | 0.00 |
| SOD1_8.57 | 12.46 | 8.04 | 6.30 | 17.45 |
| DMD_16.30 | 0.14 | 4.80 | 0.93 | 6.86 |
| DMD_16.32 | 0.60 | 0.58 | 0.02 | 1.64 |
| BCL11A_21.1 | 3.28 | 10.46 | 17.16 | 38.28 |
| PCSK9_6.8 | 1.73 | 7.44 | 11.18 | 29.00 |
| B2M_7.37 | 1.48 | 19.34 | 6.92 | 5.26 |
| CD70_26.3 | 0.08 | 3.13 | 8.24 | 12.89 |
| DMD_16.29 | 0.02 | — | — | — |
| DMD_16.31 | 0.11 | — | — | — |
| HTT_5.1 | 0.80 | — | — | — |
| DMPK_20.7 | 0.37 | — | — | — |
| B2M_7.9 | 8.14 | — | — | — |
| CD70_26.5 | 5.92 | — | — | — |
| FSHD_25.1 | 0.27 | — | — | — |
| PMP22_18.22 | 0.07 | — | — | — |
| PTBP1_28.1 | 0.03 | — | — | — |
| VCV000162497_alt | 0.03 | — | — | — |
| VCV000037426_alt | 3.75 | — | — | — |
| VCV000052759_alt | 0.00 | — | — | — |
| VCV000031157_alt | 48.50 | — | — | — |
| VCV000217157_alt | 2.26 | — | — | — |
| VCV000048146_alt | 0.14 | — | — | — |
| VCV000039614_alt | 0.27 | — | — | — |
| VCV000217646_alt | 0.72 | — | — | — |
| VCV000408199_alt | 0.59 | — | — | — |
| VCV000431973_alt | 0.13 | — | — | — |

TABLE 28-continued

Average editing of CasX 534 at spacers associated
with PAM sequences of TTC, ATC, CTC, or GTC

| Spacer Name | TTC PAM Average Percent Editing | ATC PAM Average Percent Editing | CTC PAM Average Percent Editing | GTC PAM Average Percent Editing |
|---|---|---|---|---|
| VCV000004193_alt | 0.01 | — | — | — |
| VCV000003920_alt | 1.40 | — | — | — |
| VCV000224616_alt | 0.20 | — | — | — |
| VCV000004787_alt | 0.35 | — | — | — |
| VCV000013115_alt | 0.00 | — | — | — |
| VCV000195355_alt | 0.05 | — | — | — |
| VCV000190123_alt | 0.68 | — | — | — |
| VCV000048535_alt | 1.10 | — | — | — |
| VCV000468648_alt | 2.69 | — | — | — |
| VCV000000908_alt | 0.86 | — | — | — |
| VCV000066016_alt | 0.00 | — | — | — |
| VCV000184702_alt | 0.02 | — | — | — |
| VCV000003825_alt | 1.40 | — | — | — |
| VCV000014243_alt | 0.94 | — | — | — |
| VCV000046102_alt | 0.66 | — | — | — |
| VCV000050962_alt | 0.08 | — | — | — |
| VCV000011908_alt | 1.05 | — | — | — |
| VCV000252575_alt | 1.41 | — | — | — |
| SOD1_G93A_alt | 5.13 | — | — | — |
| C9orf72_29.1 | — | 17.85 | — | — |
| VCV000092361_alt | — | 1.82 | — | — |
| VCV000096602_alt | — | 1.22 | — | — |
| DUX4_25.3_alt | — | 5.50 | — | — |
| VCV000012379_alt | — | — | 1.32 | — |
| VCV000067838_alt | — | — | 0.88 | — |
| VCV000246282_alt | — | — | 0.00 | — |
| VCV000000157_alt | — | — | 3.17 | — |
| VCV000550954_alt | — | — | 3.12 | — |
| VCV000189075_alt | — | — | 4.87 | — |
| VCV000006756_alt | — | — | 2.53 | — |
| VCV000100629_alt | — | — | 2.60 | — |
| VCV000372498_alt | — | — | 3.67 | — |
| VCV000002019_alt | — | — | 3.86 | — |
| HTT_slot_1_alt | — | — | 4.53 | — |
| HTT_slot_2_alt | — | — | 0.03 | — |
| HTT_slot_3_alt | — | — | — | 4.21 |

FIG. 38 is a bar plot showing the average editing efficiency across PAM categories and across CasX protein variants, with the standard error of the mean of two experiments plotted as error bars. These data indicate that both CasX 491 and 515 are specific for the canonical PAM sequence TTC, while other variants of CasX performed more or less efficiently at the PAM sequences tested. In particular, differing amino acids substituted at CasX position 223 were observed to favor different bases at the immediate 5' position of the PAM nucleotide sequence. The CasX variant with the highest editing activity is listed for each of these four PAM sequences in Table 29. The variant name and amino acid substitution is specified, as well as the fold improvement of editing, relative to CasX 515, for the indicated PAM sequence. These data suggest that the identity of the side chain of the amino acid at this position is critical for PAM recognition. It is likely that each of the four nucleotides is most complementary to a different network of bonds or chemical environment in this region of the CasX protein. These data can be used to engineer maximally-active therapeutic CasX molecules for a target DNA sequence of interest.

Under the conditions of the experiments, a set of variants of CasX protein 515 was identified that are improved for double-stranded DNA cleavage in human cells at target DNA sequences associated with a PAM of sequence TTC, ATC, CTC, or GTC, supporting that CasX variants with an increased spectrum of PAM specificity, relative to wild-type CasX, can be generated.

TABLE 29

Mutations to CasX 515 that improve cleavage activity at NTC PAM sequences

| CasX Protein | Position | Reference | Alternate | PAM Sequence | Fold-improvement versus 515 |
|---|---|---|---|---|---|
| 515 | 223 | G | N/A | TTC | 1.0 |
| 528 | 223 | G | Y | ATC | 6.7 |
| 535 | 223 | G | S | CTC | 5.2 |
| 534 | 223 | G | H | GTC | 3.2 |

Example 17: The PASS Assay Compares CasX Protein Variants with Improved Editing Efficiency at PAM Sequences of TTC, ATC, CTC, or GTC The purpose of the experiment was to compare the genome editing efficiency in human cells utilizing engineered and novel variants of CasX protein 2 (SEQ ID NO: 2). To accomplish this, the HEK293 cell line PASS_V1.00 was treated with wild-type reference CasX protein 2 or engineered variants 119 (SEQ ID NO: 270), 491 (SEQ ID NO: 336), and 515 (SEQ ID NO: 416), or sequence variants of 515, and Next-generation sequencing (NGS) was performed to calculate the percent editing at a variety of spacers and associated target sites.

Materials and Methods: A multiplexed pooled approach was taken to assay clonal protein variants using the PASS system. Briefly, a pooled HEK cell line was generated and termed PASS_V1.00. Each cell within the pool contained a genome-integrated single-guide RNA (sgRNA; SEQ ID NO: 2238), paired with a specific target site. After transfection of protein-expression constructs, editing at a specific target by a specific spacer could be quantified by NGS. Each guide-target pair was designed to provide data related to activity, specificity, and targetability of the CasX-guide RNP complex.

Paired spacer-target sequences were synthesized by Twist Biosciences and obtained as an equimolar pool of oligonucleotides. This pool was amplified by PCR and cloned by Golden Gate cloning to generate a final library of plasmids named p66. Each plasmid contained a sgRNA expression element and a target site, along with a GFP expression element and a hygromycin expression element. The sgRNA expression element consisted of a U6 promoter driving transcription of gRNA scaffold 174 (SEQ ID NO: 2238), followed by a spacer sequence which would target the RNP of the guide and CasX variant to the paired target site. 250 possible unique, paired spacer-target synthetic sequences were designed and synthesized. A pool of lentivirus was then produced from this plasmid library using the LentiX production system (Takara Bio USA, Inc) according to the manufacturer's instructions. The resulting viral preparation was then quantified by qPCR and transduced into a standard HEK293 cell line at a low multiplicity of infection so as to generate single copy integrations. The resulting cell line was then purified by fluorescence-activated cell sorting (FACS) to complete the production of PASS_V1.00. This cell line was then seeded in six-well plate format and treated with either water or was transfected with 2 µg of plasmid p67, delivered by Lipofectamine™ Transfection Reagent (ThermoFisher) according to the manufacturer's instructions. Plasmid p67 contains an EF-1a promoter driving expression of a CasX protein tagged with the SV40 Nuclear Localization Sequence. After five days, treated PASS_V1.00 cells were collected, lysed, and genomic DNA was extracted using a genomic DNA isolation kit (Zymo Research). Genomic DNA was then PCR amplified with custom primers to generate amplicons compatible with Illumina NGS and sequenced on a NextSeq instrument. Sample reads were demultiplexed and filtered for quality. Editing outcome metrics (fraction of reads with indels) were then quantified for each spacer-target synthetic sequence across treated samples.

To assess the editing efficiency for a molecule, editing outcome metrics for four different PAM sequences were categorized. For TTC PAM target sites, 48 different spacer-target pairs were quantified; for ATC, CTC, and GTC PAM target sites, 14, 22, and 11 individual target sites were quantified, respectively. The editing efficiency was calculated for each of these spacers and was normalized for the background signal by subtracting the editing observed in the water-treated sample.

Results: FIG. 30 is a violin plot showing the editing efficiency across PAM categories and across CasX protein variants. The editing efficiency of an individual spacer is shown as a dot, and the mean editing efficiency is indicated with a horizontal bar. Cells lipofected with any nuclease displayed higher mean editing at TTC PAM target sites (horizontal bar) than that of the wild-type nuclease Cas 2, except Cas 528 (SEQ ID NO: 428). The relative preference of any given nuclease for the four different PAM sequences is also represented by the violin plots. CasX nucleases 527 (SEQ ID NO: 427), 528 (SEQ ID NO: 428), and 529 (SEQ ID NO: 429) exhibit substantially different PAM preferences than that of the wild-type nuclease CasX 2. These data suggest that certain regions of the CasX amino acid sequence are critical for PAM recognition, and these data can be used to engineer maximally active therapeutic CasX molecules for a target DNA sequence of interest.

Under the conditions of the experiment, engineered CasX variants 119, 491, and 515, or sequence variants of 515, were identified that are improved for double-stranded DNA cleavage in human cells at target DNA sequences associated with a PAM of sequence TTC, ATC, CTC, or GTC, compared to the WT CasX 2 protein. These data support that CasX variants with an increased spectrum of PAM specificity, relative to wild-type reference CasX, can be generated.

Example 18: The PASS Assay Compares CasX Protein Variants with Improved Maximum Editing Efficiency at PAM Sequences of TTC, ATC, CTC, or GTC The purpose of the experiment was to compare CasX protein variants to determine the maximum editing efficiency at PAM sequences of TTC, ATC, CTC, or GTC for select target nucleic acid sequences. To accomplish this, the HEK293 cell line PASS_V1.00 was treated with engineered CasX protein 491 (SEQ ID NO: 336) or further engineered variants 532 (SEQ ID NO: 432) or 533 (SEQ ID NO: 433), and Next-generation sequencing (NGS) was performed to calculate the percent editing at a variety of spacers and associated target nucleic acid sites.

Materials and Methods: A multiplexed pooled approach was taken to assay clonal protein variants using the PASS system. Briefly, a pooled HEK cell line was generated and termed PASS_V1.00. Each cell within the pool contained a genome-integrated single-guide RNA (sgRNA), paired with a specific target site. After transfection of protein-expression constructs, editing at a specific target by a specific spacer could be quantified by NGS. Each guide-target pair was designed to provide data related to activity, specificity, and targetability of the CasX-guide RNP complex.

Paired spacer-target sequences were synthesized by Twist Biosciences and obtained as an equimolar pool of oligonucleotides. This pool was amplified by PCR and cloned by Golden Gate cloning to generate a final library of plasmids named p66. Each plasmid contained a sgRNA expression element and a target site, along with a GFP expression element and a hygromycin expression element. The sgRNA expression element consisted of a U6 promoter driving transcription of gRNA scaffold 174 (SEQ ID NO: 2238), followed by a spacer sequence which would target the RNP of the guide and CasX variant to the paired target site. 250 possible unique, paired spacer-target synthetic sequences were designed and synthesized. A pool of lentivirus was then produced from this plasmid library using the LentiX production system (Takara Bio USA, Inc) according to the manufacturer's instructions. The resulting viral preparation was then quantified by qPCR and transduced into a standard HEK293 cell line at a low multiplicity of infection so as to generate single copy integrations. The resulting cell line was then purified by fluorescence-activated cell sorting (FACS) to complete the production of PASS_V1.00. This cell line was then seeded in six-well plate format and treated in duplicate with either water or was transfected with 2 μg of plasmid p67, delivered by Lipofectamine™ Transfection Reagent (ThermoFisher) according to the manufacturer's instructions. Plasmid p67 contains an EF-1a promoter driving expression of a CasX protein tagged with the SV40 Nuclear Localization Sequence. After five days, treated PASS_V1.00 cells were collected, lysed, and genomic DNA was extracted using a genomic DNA isolation kit (Zymo Research). Genomic DNA was then PCR amplified with custom primers to generate amplicons compatible with Illumina NGS and sequenced on a NextSeq instrument. Sample reads were demultiplexed and filtered for quality. Editing outcome metrics (fraction of reads with indels) were then quantified for each spacer-target synthetic sequence across treated samples.

To assess the editing efficiency for a molecule, editing outcome metrics for four different PAM sequences were categorized. For TTC PAM target sites, 48 different spacer-target pairs were quantified; for ATC, CTC, and GTC PAM target sites, 14, 22, and 11 individual target sites were quantified, respectively. The editing efficiency was calculated for each of these spacers and was normalized for the background signal by subtracting the editing observed in the water-treated sample. The average of two biological replicates was then calculated, as well as the Standard Error of the Mean (SEM). Finally, for each category of PAM (TTC, ATC, CTC, or GTC), the average editing efficiency for all spacers was calculated, as well as the propagated SEM.

Results: FIG. 31 is a bar plot showing the editing efficiency across PAM categories and across CasX protein variants. Cells lipofected with Cas 532 or 533 displayed higher mean editing than CasX 491 at each of the PAM sequences, with the exception of Cas 533 at TTC PAM target sites. These data suggest that CasX variants 532 or 533 may improve editing activity at therapeutic targets of interest.

Engineered CasX variants 532 and 533 were identified to have improved editing efficiency in human cells compared to CasX 491 when the target DNA sequences were associated with a PAM of sequence TTC, ATC, CTC, or GTC. These data support that CasX variants 532 and 533 may improve the editing efficiency at therapeutic targets of interest compared to CasX 491, particularly for those targets associated with a non-canonical PAM sequence.

Example 19: The PASS Assay Identifies CasX Protein Variants with Enhanced Editing Activity Relative to CasX 491 or CasX 119

The purpose of the experiment was to identify variants of CasX with improved editing in human cells, relative to CasX 491 or 119. To accomplish this, the HEK293 cell line PASS_V1.01 was treated with the wild-type CasX protein 2 or with engineered CasX protein variants 119 or 491 (SEQ ID NO: 336) or another CasX protein variant, and Next-generation sequencing (NGS) was performed to calculate the percent editing at a variety of spacers and associated target sites.

Materials and Methods: A multiplexed pooled approach was taken to assay clonal protein variants using the PASS system. Briefly, a pooled HEK cell line was generated and termed PASS_V1.01. Each cell within the pool contained a genome-integrated single-guide RNA (sgRNA: SEQ ID NO: 2238), paired with a specific target site (listed in Table 30). After transfection of protein-expression constructs, editing at a specific target by a specific spacer could be quantified by NGS. Each guide-target pair was designed to provide data related to activity, specificity, and targetability of the CasX-guide RNP complex.

Paired spacer-target sequences were synthesized by Twist Biosciences and obtained as an equimolar pool of oligonucleotides. This pool was amplified by PCR and cloned by Golden Gate cloning to generate a final library of plasmids named p77. Each plasmid contained a sgRNA expression element and a target site, along with a GFP expression element. The sgRNA expression element consisted of a U6 promoter driving transcription of gRNA scaffold 174 (SEQ ID NO: 2238), followed by a spacer sequence which would target the RNP of the guide and CasX variant to the paired target site. 250 possible unique, paired spacer-target synthetic sequences were designed and synthesized. A pool of lentivirus was then produced from this plasmid library using the LentiX production system (Takara Bio USA, Inc) according to the manufacturer's instructions. The resulting viral preparation was then quantified by qPCR and transduced into a standard HEK293 cell line at a low multiplicity of infection so as to generate single copy integrations. The resulting cell line was then purified by fluorescence-activated cell sorting (FACS) to complete the production of PASS_V1.01. This cell line was then seeded in six-well plate format and treated either in duplicate or as a single sample with either water or was transfected with 2 μg of plasmid p67, delivered by Lipofectamine™ Transfection Reagent (ThermoFisher) according to the manufacturer's instructions. Plasmid p67 contains an EF-1a promoter driving expression of a CasX protein tagged with the SV40 Nuclear Localization Sequence as well as a puromycin resistance gene. After one day, cells were transferred to media selective for puromycin resistance (Sigma). After an additional four days, treated PASS_V1.01 cells were collected, lysed, and genomic DNA was extracted using a genomic DNA isolation kit (Zymo Research). Genomic DNA was then PCR amplified with custom primers to generate amplicons compatible with Illumina NGS and sequenced on a NextSeq instrument. Sample reads were demultiplexed and filtered for quality. Editing outcome metrics (fraction of reads with indels) were then quantified for each spacer-target synthetic sequence across treated samples.

To assess the editing activity of a CasX nuclease at human target sites, 48 TTC PAM target sites were quantified. The average editing efficiency and standard error of the mean for two biological replicates was calculated for each of these spacers where indicated. The average editing efficiency across the 48 spacers also calculated, along with the propagated standard error of the mean, where indicated.

Results: FIG. 39 is a bar plot showing the average editing efficiency, relative to CasX 491, of select CasX nucleases at 48 different TTC PAM target sites in human cells. The propagated standard error of the mean of two experiments plotted as error bars. These data indicate that both CasX 119 and 491 are substantially more efficient than wild-type CasX 2. In addition, CasX 515 is not significantly different compared to the editing efficiency of CasX 491. Surprisingly, CasX 527 exhibited improved efficiency compared to 491 at TTC PAM sequences (p=0.0000635 by Welch's two-tailed t-test). CasX nuclease 527 was engineered to exhibit improved editing efficiency at PAM sequences of ATC, CTC, or GTC, potentially by stabilizing the R-loop structure of the CasX ribonuclear protein (RNP) with double-stranded DNA target sites with non-canonical PAM sequences. CasX 527 consists of an arginine amino acid inserted at position 26 of CasX 491. This position is physically proximal to the interaction of the CasX PAM recognition loop (amino acid position 223) with the PAM nucleotides of the DNA non-target strand (NTS).

FIG. 40 diagrams the positions of the PAM recognition loop and the CasX 527 mutation, position 26, on the published CryoEM structure of the homologous reference CasX protein 1 (SEQ ID NO:1; Protein Data Bank Identification Number: 6NY2). It is likely that additional ionic interactions between the inserted arginine and the DNA NTS facilitate improved stability at any of the PAM sequences TTC, ATC, CTC, or GTC, leading to improved overall editing efficiency at these spacers.

FIG. 41 is a violin plot comparing the editing efficiency of CasX 2 and CasX 527 to select variants of CasX 515 at 48 TTC PAM spacers, with the median editing efficiency represented as a horizontal bar. As discussed above, CasX 527 was previously observed to have editing efficiency equal to or better than CasX 491, and several novel CasX variants were here observed to have further improved editing efficiency relative to CasX 527. Unexpectedly, the editing rates for CasX 583 were particularly uniform and high. This may be the result of a large improvement in the stability of the R-loop structure, such that editing variation typically observed between spacers was mostly overcome. Supporting this hypothesis, CasX 583 differs from CasX 515 by the substitution of a hydrophobic leucine at position 168 for a positively charged lysine in the non-target strand binding domain (NTSB) of the protein, which may facilitate additional ionic bonds to the NTS of the target DNA. This region is unstructured in the CryoEM structure discussed above and the NTSB domain has been labeled for clarity. Table 30 lists the editing efficiency for 48 TTC PAM spacers when targeted with CasX protein variant 527 or 583, demonstrating the enhanced editing efficiency of the CasX 583 at the majority of the targets, under the conditions of the assay. The spacer name and associated PAM sequence are indicated.

FIG. 42 is a bar plot showing the average editing efficiency, relative to CasX 491, of select CasX nucleases at 48 different TTC PAM target sites in human cells. The propagated standard error of the mean of two experiments plotted as error bars. The grey dashed line indicates the editing activity of CasX 119. These data indicate that CasX variants from 429 to 458 exhibit variable editing efficiency relative to CasX 119, and in some cases exhibit improved editing efficiency relative to CasX 119, which edits at 70.8% relative to CasX 491. In particular, CasX 450 was substantially more efficient than CasX 119, editing at 95.9% relative to CasX 491, and consists of four substitution mutations relative to the CasX 119 sequence. These four substitution mutations are as follows: D732N, E385P, Y857R, I658V. Importantly, CasX 449 consists of the same sequence, minus the substitution of I658V, and is considerably less efficient, editing at only 58.1% relative to CasX 491. This comparison indicates that this mutation is of critical importance for the increase in activity. These data demonstrate that improved editing activity is achievable when combinations of substitution mutations are made to CasX 119. Notably, these enhancements to activity are separate from the enhancements observed to arise from domain exchange between homologous CasX protein sequences. In particular, CasX 484 differs from CasX 491 only by replacement of the CasX 2 domains NTSB and Helical Ib with those found CasX 1, with a corresponding increase in activity from 62.0% to 100.0%. These data show that CasX 119 nuclease activity can be enhanced by combinations of individual substitution mutations or by domain exchange with homologous CasX proteins.

Under the conditions of the experiments, a set of variants of CasX protein 491 or 515 were identified that are improved for double-stranded DNA cleavage in human cells at target DNA sequences associated with a PAM of sequence TTC, and provide evidence of specific locations or combinations of locations for mutations that could be used to further engineer CasX variants molecules with enhanced activity for a target DNA sequence of interest.

TABLE 30

Percent editing of CasX 527 or CasX 583 at 48 spacers associated with PAM sequences of TTC

| Spacer Name | CasX 527 Percent Editing | CasX 583 Percent Editing |
| --- | --- | --- |
| Rho_11.24 | 26.0 | 38.9 |
| SOD1_8.89 | 25.9 | 38.9 |
| SOD1_8.57 | 42.4 | 22.2 |
| DMD_16.29 | 5.0 | 0.0 |
| DMD_16.30 | 33.0 | 62.5 |
| DMD_16.31 | 44.1 | 70.3 |
| DMD_16.32 | 19.1 | 66.3 |
| BCL11A_21.1 | 53.1 | 74.0 |
| PCSK9_6.8 | 25.9 | 57.9 |
| HTT_5.1 | 45.3 | 74.6 |
| DMPK_20.7 | 19.9 | 56.3 |
| B2M_7.9 | 53.9 | 72.7 |
| B2M_7.37 | 32.5 | 59.9 |
| CD70_26.5 | 37.7 | 66.0 |
| CD70_26.3 | 27.2 | 78.0 |
| FSHD_25.1 | 19.4 | 0.0 |
| PMP22_18.22 | 31.9 | 66.4 |
| PTBP1_28.1 | 17.4 | 0.0 |
| Rho_11.2 | 32.4 | 59.5 |
| VCV000162497_alt | 22.6 | 27.4 |
| VCV000037426_alt | 34.7 | 34.7 |
| VCV000052759_alt | 43.8 | 84.8 |
| VCV000031157_alt | 27.5 | 0.0 |
| VCV000217157_alt | 17.7 | 21.4 |
| VCV000048146_alt | 36.8 | 53.3 |
| VCV000039614_alt | 42.9 | 73.1 |
| VCV000217646_alt | 39.7 | 81.8 |
| VCV000408199_alt | 28.5 | 64.2 |
| VCV000431973_alt | 40.6 | 62.2 |
| VCV000004193_alt | 18.7 | 15.8 |
| VCV000003920_alt | 31.1 | 68.1 |
| VCV000224616_alt | 20.6 | 58.9 |
| VCV000004787_alt | 37.9 | 61.7 |
| VCV000013115_alt | 0.0 | 100.0 |
| VCV000195355_alt | 45.3 | 83.3 |
| VCV000190123_alt | 49.1 | 78.1 |
| VCV000048535_alt | 32.9 | 61.2 |
| VCV000468648_alt | 38.4 | 77.9 |

TABLE 30-continued

Percent editing of CasX 527 or CasX 583 at 48
spacers associated with PAM sequences of TTC

| Spacer Name | CasX 527 Percent Editing | CasX 583 Percent Editing |
| --- | --- | --- |
| VCV000000908_alt | 30.7 | 64.3 |
| VCV000066016_alt | 0.0 | 0.0 |
| VCV000184702_alt | 41.8 | 8.1 |
| VCV000003825_alt | 30.2 | 55.7 |
| VCV000014243_alt | 36.2 | 77.9 |
| VCV000046102_alt | 47.3 | 74.6 |
| VCV000050962_alt | 24.9 | 67.4 |
| VCV000011908_alt | 30.0 | 64.8 |
| VCV000252575_alt | 17.9 | 38.3 |
| SOD1_G93A_alt | 37.5 | 80.2 |

Example 20: The PASS Assay Identifies CasX Protein Variants with Enhanced Specificity Relative to CasX 491

The purpose of the experiment was to identify variants of CasX with improved specificity for cleavage at on-target versus off-target sites in human cells. To accomplish this, the HEK293 cell line PASS_V1.01 was treated with the wild-type CasX protein 2 or with engineered CasX protein variants 119 or 491 (SEQ ID NO: 336) or another CasX protein variant, along with a single-guide RNA (sgRNA; SEQ ID NO: 2238), and Next-generation sequencing (NGS) was performed to calculate the percent editing at a variety of spacers and associated target sites.

Materials and Methods: A multiplexed pooled approach was taken to assay clonal protein variants using the PASS system, as described in Example 19.

To assess the editing activity as well as specificity of a CasX nuclease at human target sites, two sets of target sites were quantified. First, 48 TTC PAM target sites were quantified, and the average editing efficiency and standard error of the mean for two biological replicates was calculated for each of these spacers. The average editing efficiency across the 48 spacers was also calculated, along with the propagated standard error of the mean. Second, 28 sets of two TTC PAM spacer-target site pairs were quantified. Each set of spacer-target pairs consisted of a fixed spacer sequence and two differing target sites. The two target sites differed by a single nucleotide mismatch at one of the twenty positions of the target site. One target site (the on-target spacer-target pair) was perfectly complementary to the spacer sequence, while the other (the off-target spacer-target pair) consists of a mismatch between the RNA of the spacer and the DNA target strand. Average editing efficiency and standard error of the mean for two biological replicates was calculated for each of these spacers. The ratio of editing efficiency between the off-target and the on-target sites was calculated, as well as the propagated standard error of the mean, for each of these 28 sets of target sites. This metric is defined as the Specificity Ratio. Finally, the average Specificity Ratio across the 28 sets of target sites was calculated, as well as the propagated standard error of the mean.

Results: FIG. 43 is a bar plot showing the average editing efficiency relative to CasX 491 as well as the average Specificity ratio of select CasX nucleases. The propagated standard error of the mean of two experiments plotted as error bars. These data indicate that both CasX 119 and 491 are substantially more efficient than wild-type CasX 2, and that CasX 119 remains specific for single nucleotide mismatches within the spacer (low Specificity Ratio) compared to CasX 2 (average Specificity Ratio of 0.171 for CasX 2, versus 0.182 for CasX 119). In contrast, CasX 491 has lost a considerable amount of specificity for single nucleotide mismatches under these conditions (average Specificity Ratio of 0.446). An additional mutation to CasX 491 (insertion of proline at position 793) to generate CasX 515 slightly improves the specificity of the molecule, although this result is not statistically significant. Furthermore, an insertion of an arginine at position 26 of CasX 491 to generate CasX 527 significantly and substantially worsens the specificity of the molecule (average Specificity Ratio of 0.839). Importantly however, additional single mutations to CasX 515 further improve the specificity of the molecule. CasX 535, 537, 542, 543, and 544 all significantly improve the specificity. CasX 544 improves the specificity the most, to an average Specificity Ratio of 0.183, which is not significantly different from that of the wild-type CasX 2. At the same time, CasX 544 maintains an average editing efficiency of 97.7% compared to that of CasX 491 and is not significantly different. These data demonstrate that single mutations made to CasX 491 or 515 can alter either the activity or the specificity, or both, of the nuclease when editing targeted DNA sequences in human cells. FIG. 68 is a flow-chart illustrating the qualitative relationship between tested combinations of mutations and their effect on both activity and specificity. Table 31 quantifies the average percent editing of CasX 491 at 28 sets of on-target or off-target spacer-target pairs, illustrating the average ratio of on-target versus off-target editing efficiency. Table 32 quantifies the average editing activity of select CasX variants relative to CasX 2 or CasX variant 491, as well as the average Specificity Ratio for each variant as the absolute value between zero and one. In all cases, the engineered variants showed improved editing efficiency compared to reference CasX 2 (SEQ ID NO: 2), with 4-fold to nearly 7-fold more editing, under the conditions of the assay, while CasX 527 (SEQ ID NO: 427) and 532 (SEQ ID NO: 432) showed improvements relative to CasX 491 (SEQ ID NO: 336). CasX 542 (SEQ ID NO: 442), 543 (SEQ ID NO: 443), and 544 (SEQ ID NO: 444) were essentially as active as CasX 491, but retained specificity comparable to reference CasX 2.

Under the conditions of the experiments, a set of variants of CasX protein 491 or 515 were identified that are improved for double-stranded DNA cleavage in human cells at target DNA sequences associated with a PAM of sequence TTC. In addition, the specificity of these protein variants was quantified by measuring editing at on-target versus off-target sites. These data can be used to engineer maximally active and maximally specific therapeutic CasX variant molecules for a target DNA sequence of interest.

TABLE 31

Average percent editing of CasX 491 at 28 sets
of on-target or off-target spacer-target pairs

| Spacer Name | CasX 491 Average On-target Percent Editing | CasX 491 Average Off-target Percent Editing |
| --- | --- | --- |
| VCV000162497_alt | 15.4 | 2.0 |
| VCV000037426_alt | 21.9 | 0.1 |
| VCV000052759_alt | 35.4 | 25.8 |
| VCV000031157_alt | 12.8 | 5.4 |
| VCV000217157_alt | 11.7 | 6.9 |
| VCV000048146_alt | 21.8 | 0.3 |
| VCV000039614_alt | 38.0 | 13.3 |
| VCV000217646_alt | 38.2 | 9.2 |
| VCV000408199_alt | 31.2 | 47.5 |

TABLE 31-continued

Average percent editing of CasX 491 at 28 sets
of on-target or off-target spacer-target pairs

| Spacer Name | CasX 491 Average On-target Percent Editing | CasX 491 Average Off-target Percent Editing |
|---|---|---|
| VCV000431973_alt | 35.7 | 0.0 |
| VCV000004193_alt | 7.4 | 0.2 |
| VCV000003920_alt | 32.0 | 24.2 |
| VCV000224616_alt | 33.1 | 30.7 |
| VCV000004787_alt | 41.8 | 32.7 |
| VCV000013115_alt | 16.2 | 43.7 |
| VCV000195355_alt | 42.6 | 10.6 |
| VCV000190123_alt | 39.1 | 6.0 |
| VCV000048535_alt | 31.9 | 6.6 |
| VCV000468648_alt | 35.7 | 35.1 |
| VCV000000908_alt | 45.2 | 10.6 |
| VCV000066016_alt | 40.6 | 1.8 |
| VCV000184702_alt | 16.8 | 0.0 |
| VCV000003825_alt | 29.9 | 27.1 |
| VCV000014243_alt | 37.0 | 5.9 |
| VCV000046102_alt | 38.1 | 17.0 |
| VCV000050962_alt | 31.6 | 8.5 |
| VCV000011908_alt | 43.5 | 7.3 |
| VCV000252575_alt | 21.3 | 44.1 |

TABLE 32

Activity and specificity of CasX proteins

| CasX Protein | Average editing efficiency relative to CasX 2 (%) | Average editing efficiency relative to CasX 491 (%) | Average Specificity Ratio |
|---|---|---|---|
| 2 | 100 | 17 | 0.17 |
| 119 | 429 | 71 | 0.18 |
| 491 | 606 | 100 | 0.45 |
| 515 | 602 | 99 | 0.37 |
| 527 | 694 | 115 | 0.84 |
| 532 | 677 | 112 | 0.63 |
| 535 | 541 | 89 | 0.27 |
| 536 | 513 | 85 | 0.29 |
| 537 | 470 | 78 | 0.25 |
| 542 | 575 | 95 | 0.19 |
| 543 | 539 | 89 | 0.17 |
| 544 | 592 | 98 | 0.18 |

Example 21: Improved Guide RNA Variants Demonstrate Enhanced On-Target Activity at Mouse and Human RHO Exon 1 Loci In Vitro Experiments were conducted to identify novel engineered guide RNA variants with increased activity at different genomic targets, including the therapeutically-relevant mouse and human Rho exon 1. Previous assays identified many different "hotspot" regions (e.g., stem loop) within the scaffold sequences holding the potential to significantly increase editing efficiency as well as specificity (sequences in Table 33). Additionally, screens were conducted to identify scaffold variants that would increase the overall activity of our CRISPR system in an AAV vector across multiple different PAM-spacer combinations, without triggering off-target or non-specific editing. Achieving increased editing efficiency compared to current benchmark vectors would allow reduced viral vector doses to be used in in vivo studies, improving the safety of AAV-mediated CasX-guide systems.

Materials and Methods:

New CasX variant sequences and gRNA scaffold variants were inserted into an AAV transgene construct for plasmid and viral vector validation. We conceptually broke up the AAV transgene between ITRs into different parts, which consisted of our therapeutic cargo (CasX and gRNA variants+spacer) and accessory elements (e.g., promoters, NLS, poly(A)) relevant to expression in mammalian cells. Each part in the AAV genome was separated by restriction enzyme sites to allow for modular cloning. Parts were ordered as gene fragments from Twist, were PCR amplified and digested with corresponding restriction enzymes, cleaned, then ligated into a vector digested with the same enzymes. New AAV constructs were then transformed into chemically competent E. coli (Turbos or Stb13s), which were plated on Kanamycin LB-Agar plates following recovery at 37° C. for 1 hour. Single colonies were picked, mini-prepped, and Sanger-sequenced. Sequence-verified constructs were then cloned into a BbsI Golden-Gate assembly with spacer 12.7 (targeting tdTomato: CTGCATTCTAGTTGTGGTTT, SEQ ID NO: 194). Spacers were made by annealing two oligos and diluting in water. The transformation and miniprep protocols were then repeated and spacer-cloned vectors were sequence-verified again. Validated constructs were maxi-prepped. To assess the quality of maxi-preps, constructs were processed in two separate digests with XmaI (which cuts at several sites in each of the ITRs) and XhoI, which cuts once in the AAV genome. These digests and the uncut construct were then run on a 1% Agarose gel and imaged on a ChemiDoc. If the plasmid was >90% supercoiled, was the correct size, and the ITRs were intact, the construct moved on to be tested via nucleofection and subsequently used AAV vector production.

TABLE 33

Guide sequences cloned into p59.491.U6.X.Y. plasmids. (X = guide; Y = spacer)

| Guide Construct | Spacer Sequence | Guide Sequence | Guide + Spacer Sequence |
|---|---|---|---|
| 174.12.7 | CTGCATTCTA GTTGTGGTTT (SEQ ID NO: 194) | ACTGGCGCTTTTATCTGATTACT TTGAGAGCCATCACCAGCGACT ATGTCGTAGTGGGTAAAGCTCC CTCTTCGGAGGGAGCATCAAAG (SEQ ID NO: 702) | ACTGGCGCTTTTATCTGATTACTTTGAGAG CCATCACCAGCGACTATGTCGTAGTGGGT AAAGCTCCCTCTTCGGAGGGAGCATCAAA GCTGCATTCTAGTTGTGGTTT (SEQ ID NO: 727) |
| 229.12.7 | CTGCATTCTA GTTGTGGTT (SEQ ID NO: 195) | ACTGGCACTTTTATCTGATTACT TTGAGAGCCATCACCAGCGACT ATGTCGTATGGGTAAAGCGCTT ACGGACTTCGGTCCGTAAGAAG CATCAAAG (SEQ ID NO: 703) | ACTGGCACTTTTATCTGATTACTTTGAGAG CCATCACCAGCGACTATGTCGTATGGGTA AAGCGCTTACGGACTTCGGTCCGTAAGAA GCATCAAAGCTGCATTCTAGTTGTGGTTT (SEQ ID NO: 728) |

TABLE 33-continued

Guide sequences cloned into p59.491.U6.X.Y. plasmids. (X = guide; Y = spacer)

| Guide Construct | Spacer Sequence | Guide Sequence | Guide + Spacer Sequence |
|---|---|---|---|
| 230.12.7 | CTGCATTCTA GTTGTGGTT (SEQ ID NO: 195) | ACTGGCACTTCTATCTGATTACT CTGAGAGCCATCACCAGCGACT ATGTCGTATGGGTAAAGCGCTT ACGGACTTCGGTCCGTAAGAAG CATCAGA (SEQ ID NO: 704) | ACTGGCACTTCTATCTGATTACTCTGAGAG CCATCACCAGCGACTATGTCGTATGGGTA AAGCGCTTACGGACTTCGGTCCGTAAGAA GCATCAGAGCTGCATTCTAGTTGTGGTTT (SEQ ID NO: 729) |
| 231.12.7 | CTGCATTCTA GTTGTGGTT (SEQ ID NO: 195) | ACTGGCGCTTCTATCTGATTACT CTGAGAGCCATCACCAGCGACT ATGTCGTATGGGTAAAGCCGCT TACGGACTTCGGTCCGTAAGAG GCATCAGAG (SEQ ID NO: 705) | ACTGGCGCTTCTATCTGATTACTCTGAGAG CCATCACCAGCGACTATGTCGTATGGGTA AAGCCGCTTACGGACTTCGGTCCGTAAGA GGCATCAGAGCTGCATTCTAGTTGTGGTTT (SEQ ID NO: 730) |
| 232.12.7 | CTGCATTCTA GTTGTGGTT (SEQ ID NO: 195) | ACTGGCACTTCTATCTGATTACT CTGAGCGCCATCACCAGCGACT ATGTCGTATGGGTAAAGCCGCT TACGGACTTCGGTCCGTAAGAG GCATCAGAG (SEQ ID NO: 706) | ACTGGCACTTCTATCTGATTACTCTGAGCG CCATCACCAGCGACTATGTCGTATGGGTA AAGCCGCTTACGGACTTCGGTCCGTAAGA GGCATCAGAGCTGCATTCTAGTTGTGGTTT (SEQ ID NO: 731) |
| 233.12.7 | CTGCATTCTA GTTGTGGTT (SEQ ID NO: 195) | ACTGGCGCTTCTATCTGATTACT CTGAGCGCCATCACCAGCGACT ATGTCGTATGGGTAAAGCCGCT TACGGACTTCGGTCCGTAAGAG GCATCAGAG (SEQ ID NO: 707) | ACTGGCGCTTCTATCTGATTACTCTGAGCG CCATCACCAGCGACTATGTCGTATGGGTA AAGCCGCTTACGGACTTCGGTCCGTAAGA GGCATCAGAGCTGCATTCTAGTTGTGGTTT (SEQ ID NO: 732) |
| 234.12.7 | CTGCATTCTA GTTGTGGTT (SEQ ID NO: 195) | ACTGGCGCTTCTATCTGATTACT CTGAGCGCCATCACCAGCGACT ATGTCGTATGGGTAAAGCGCCT TACGGACTTCGGTCCGTAAGGA GCATCAGAG (SEQ ID NO: 708) | ACTGGCGCTTCTATCTGATTACTCTGAGCG CCATCACCAGCGACTATGTCGTATGGGTA AAGCGCCTTACGGACTTCGGTCCGTAAGG AGCATCAGAGCTGCATTCTAGTTGTGGTTT (SEQ ID NO: 733) |
| 235.12.7 | CTGCATTCTA GTTGTGGTT (SEQ ID NO: 195) | ACTGGCGCTTCTATCTGATTACT CTGAGCGCCATCACCAGCGACT ATGTCGTAGTGGGTAAAGCCGC TTACGGACTTCGGTCCGTAAGA GGCATCAGAG (SEQ ID NO: 709) | ACTGGCGCTTCTATCTGATTACTCTGAGCG CCATCACCAGCGACTATGTCGTAGTGGGT AAAGCCGCTTACGGACTTCGGTCCGTAAG AGGCATCAGAGCTGCATTCTAGTTGTGGT T (SEQ ID NO: 734) |
| 236.12.7 | CTGCATTCTA GTTGTGGTT (SEQ ID NO: 195) | ACGGGACTTTCTATCTGATTACT CTGAAGTCCCTCACCAGCGACT ATGTCGTATGGGTAAAGCCGCT TACGGACTTCGGTCCGTAAGAG GCATCAGAG (SEQ ID NO: 710) | ACGGGACTTTCTATCTGATTACTCTGAAGT CCCTCACCAGCGACTATGTCGTATGGGTA AAGCCGCTTACGGACTTCGGTCCGTAAGA GGCATCAGAGCTGCATTCTAGTTGTGGTT (SEQ ID NO: 735) |
| 237.12.7 | CTGCATTCTA GTTGTGGTT (SEQ ID NO: 195) | ACCTGTAGTTCTATCTGATTACT CTGACTACAGTCACCAGCGACT ATGTCGTATGGGTAAAGCCGCT TACGGACTTCGGTCCGTAAGAG GCATCAGAG (SEQ ID NO: 711) | ACCTGTAGTTCTATCTGATTACTCTGACTA CAGTCACCAGCGACTATGTCGTATGGGTA AAGCCGCTTACGGACTTCGGTCCGTAAGA GGCATCAGAGCTGCATTCTAGTTGTGGTT (SEQ ID NO: 736) |
| 174.11.30 | AAGGGGCT CCGCACCA CGCC (SEQ ID NO: 204) | ACTGGCGCTTTTATCTGATTACT TTGAGAGCCATCACCAGCGACT ATGTCGTAGTGGGTAAAGCTCC CTCTTCGGAGGGAGCATCAAAG (SEQ ID NO: 702) | ACTGGCGCTTTTATCTGATTACTTTGAGAG CCATCACCAGCGACTATGTCGTAGTGGGT AAAGCTCCCTCTTCGGAGGGAGCATCAAA GAAGGGGCTCCGCACCACGCC (SEQ ID NO: 737) |
| 229.11.30 | AAGGGGCT CCGCACCA CGCC (SEQ ID NO: 204) | ACTGGCACTTTTATCTGATTACT TTGAGAGCCATCACCAGCGACT ATGTCGTATGGGTAAAGCGCTT ACGGACTTCGGTCCGTAAGAAG CATCAAAG (SEQ ID NO: 703) | ACTGGCACTTTTATCTGATTACTTTGAGAG CCATCACCAGCGACTATGTCGTATGGGTA AAGCGCTTACGGACTTCGGTCCGTAAGAA GCATCAAAGAAGGGGCTCCGCACCACGCC (SEQ ID NO: 738) |
| 230.11.30 | AAGGGGCT CCGCACCA CGCC (SEQ ID NO: 204) | ACTGGCACTTCTATCTGATTACT CTGAGAGCCATCACCAGCGACT ATGTCGTATGGGTAAAGCGCTT ACGGACTTCGGTCCGTAAGAAG CATCAGA (SEQ ID NO: 704) | ACTGGCACTTCTATCTGATTACTCTGAGAG CCATCACCAGCGACTATGTCGTATGGGTA AAGCGCTTACGGACTTCGGTCCGTAAGAA GCATCAGAAGGGGCTCCGCACCACGCC (SEQ ID NO: 739) |
| 231.11.30 | AAGGGGCT CCGCACCA CGCC (SEQ ID NO: 204) | ACTGGCGCTTCTATCTGATTACT CTGAGAGCCATCACCAGCGACT ATGTCGTATGGGTAAAGCCGCT TACGGACTTCGGTCCGTAAGAG GCATCAGAG (SEQ ID NO: 705) | ACTGGCGCTTCTATCTGATTACTCTGAGAG CCATCACCAGCGACTATGTCGTATGGGTA AAGCCGCTTACGGACTTCGGTCCGTAAGA GGCATCAGAGAAGGGGCTCCGCACCACGC C (SEQ ID NO: 740) |
| 232.11.30 | AAGGGGCT CCGCACCA CGCC (SEQ | ACTGGCACTTCTATCTGATTACT CTGAGCGCCATCACCAGCGACT ATGTCGTATGGGTAAAGCCGCT | ACTGGCACTTCTATCTGATTACTCTGAGCG CCATCACCAGCGACTATGTCGTATGGGTA AAGCCGCTTACGGACTTCGGTCCGTAAGA |

TABLE 33-continued

Guide sequences cloned into p59.491.U6.X.Y. plasmids. (X = guide; Y = spacer)

| Guide Construct | Spacer Sequence | Guide Sequence | Guide + Spacer Sequence |
|---|---|---|---|
| | ID NO: 204) | TACGGACTTCGGTCCGTAAGAG GCATCAGAG (SEQ ID NO: 706) | GGCATCAGAGAAGGGGCTCCGCACCACGC C (SEQ ID NO: 741) |
| 233.11.30 | AAGGGGCT CCGCACCA CGCC (SEQ ID NO: 204) | ACTGGCGCTTCTATCTGATTACT CTGAGCGCCATCACCAGCGACT ATGTCGTATGGGTAAAGCCGCT TACGGACTTCGGTCCGTAAGAG GCATCAGAG (SEQ ID NO: 707) | ACTGGCGCTTCTATCTGATTACTCTGAGCG CCATCACCAGCGACTATGTCGTATGGGTA AAGCCGCTTACGGACTTCGGTCCGTAAGA GGCATCAGAGAAGGGGCTCCGCACCACGC C (SEQ ID NO: 742) |
| 234.11.30 | AAGGGGCT CCGCACCA CGCC (SEQ ID NO: 204) | ACTGGCGCTTCTATCTGATTACT CTGAGCGCCATCACCAGCGACT ATGTCGTATGGGTAAAGCGCCT TACGGACTTCGGTCCGTAAGGA GCATCAGAG (SEQ ID NO: 708) | ACTGGCGCTTCTATCTGATTACTCTGAGCG CCATCACCAGCGACTATGTCGTATGGGTA AAGCGCCTTACGGACTTCGGTCCGTAAGG AGCATCAGAGAAGGGGCTCCGCACCACGC C (SEQ ID NO: 743) |
| 235.11.30 | AAGGGGCT CCGCACCA CGCC (SEQ ID NO: 204) | ACTGGCGCTTCTATCTGATTACT CTGAGCGCCATCACCAGCGACT ATGTCGTAGTGGGTAAAGCCGC TTACGGACTTCGGTCCGTAAGA CC (SEQ ID NO: 744) | ACTGGCGCTTCTATCTGATTACTCTGAGCG CCATCACCAGCGACTATGTCGTAGTGGGT AAAGCCGCTTACGGACTTCGGTCCGTAAG AGGCATCAGAGAAGGGGCTCCGCACCACG GGCATCAGAG (SEQ ID NO: 709) |
| 236.11.30 | AAGGGGCT CCGCACCA CGCC (SEQ ID NO: 204) | ACGGGACTTTCTATCTGATTACT CTGAAGTCCCTCACCAGCGACT ATGTCGTATGGGTAAAGCCGCT TACGGACTTCGGTCCGTAAGAG GCATCAGAG (SEQ ID NO: 710) | ACGGGACTTTCTATCTGATTACTCTGAAGT CCCTCACCAGCGACTATGTCGTATGGGTA AAGCCGCTTACGGACTTCGGTCCGTAAGA GGCATCAGAGAAGGGGCTCCGCACCACGC C (SEQ ID NO: 745) |
| 237.11.30 | AAGGGGCT CCGCACCA CGCC (SEQ ID NO: 204) | ACCTGTAGTTCTATCTGATTACT CTGACTACAGTCACCAGCGACT ATGTCGTATGGGTAAAGCCGCT TACGGACTTCGGTCCGTAAGAG GCATCAGAG (SEQ ID NO: 711) | ACCTGTAGTTCTATCTGATTACTCTGACTA CAGTCACCAGCGACTATGTCGTATGGGTA AAGCCGCTTACGGACTTCGGTCCGTAAGA GGCATCAGAGAAGGGGCTCCGCACCACGC C (SEQ ID NO: 746) |
| 174.11.31 | AAGTGGCTC CGCACCACG CC (SEQ ID NO: 215) | ACTGGCGCTTTTATCTGATTACT TTGAGAGCCATCACCAGCGACT ATGTCGTAgTGGGTAAAGCTCC CTCTTCGGAGGGAGCATCAAAG (SEQ ID NO: 702) | ACTGGCGCTTTTATCTGATTACTTTGAGAG CCATCACCAGCGACTATGTCGTAgTGGGTA AAGCTCCCTCTTCGGAGGGAGCATCAAAG AAGTGGCTCCGCACCACGCC (SEQ ID NO: 747) |
| 235.11.31 | AAGTGGCTC CGCACCACG CC (SEQ ID NO: 215) | ACTGGCGCTTCTATCTGATTACT CTGAGCGCCATCACCAGCGACT ATGTCGTAGTGGGTAAAGCCGC TTACGGACTTCGGTCCGTAAGA CC (SEQ ID NO: 748) | ACTGGCGCTTCTATCTGATTACTCTGAGCG CCATCACCAGCGACTATGTCGTAGTGGGT AAAGCCGCTTACGGACTTCGGTCCGTAAG AGGCATCAGAGAAGTGGCTCCGCACCACG GGCATCAGAG (SEQ ID NO: 709) |
| 174.11.1 | AAGGGGCTG CGTACCACA CC (SEQ ID NO: 216) | ACTGGCGCTTTTATCTGATTACT TTGAGAGCCATCACCAGCGACT ATGTCGTAGTGGGTAAAGCTCC CTCTTCGGAGGGAGCATCAAAG (SEQ ID NO: 702) | ACTGGCGCTTTTATCTGATTACTTTGAGAG CCATCACCAGCGACTATGTCGTAGTGGGT AAAGCTCCCTCTTCGGAGGGAGCATCAAA GAAGGGGCTGCGTACCACACC (SEQ ID NO: 749) |
| 235.11.1 | AAGGGGCTG CGTACCACA CC (SEQ ID NO: 216) | ACTGGCGCTTCTATCTGATTACT CTGAGCGCCATCACCAGCGACT ATGTCGTAGTGGGTAAAGCCGC TTACGGACTTCGGTCCGTAAGA GGCATCAGAG (SEQ ID NO: 709) | ACTGGCGCTTCTATCTGATTACTCTGAGCG CCATCACCAGCGACTATGTCGTAGTGGGT AAAGCCGCTTACGGACTTCGGTCCGTAAG AGGCATCAGAGAAGGGGCTGCGTACCA CACC (SEQ ID NO: 750) |
| 235.NT | GGGTCTTCG AGAAGACC C (SEQ ID NO: 218) | ACTGGCGCTTCTATCTGATTACT CTGAGCGCCATCACCAGCGACT ATGTCGTAGTGGGTAAAGCCGC TTACGGACTTCGGTCCGTAAGA GGCATCAGAG (SEQ ID NO: 709) | ACTGGCGCTTCTATCTGATTACTCTGAGCG CCATCACCAGCGACTATGTCGTAGTGGGT AAAGCCGCTTACGGACTTCGGTCCGTAAG AGGCATCAGAGGGGTCTTCGAGAAGAC CC (SEQ ID NO: 751) |

Reporter Cell Lines:

An immortalized neural progenitor cell line isolated from the Ai9-tdTomato was cultured in suspension in pre-equilibrated mNPC medium (DMEM/F12 with GlutaMax, 10 mM HEPES, 1×MEM Non-Essential Amino Acids, 1× Penicillin/Streptomycin, 1:1000 2-mercaptoethanol, 1×B-27 supplement, minus vitamin A, 1×N2 with supplemented growth factors bFGF and EGF). Prior to testing, cells were lifted using accutase, with gentle resuspension, monitoring for complete separation of the neurospheres. Cells were then quenched with media, spun down and resuspended in fresh media. Cells were counted and directly used for nucleofection or 10,000 cells were incubated in a 96-well plate coated with PLF (1× Poly-DL-ornithine hydrobromide, 10 mg/mL in sterile diH20, 1× Laminin, and 1× Fibronectin), 2 days prior to AAV transduction.

A HEK293T dual reporter cell line was generated by knocking into HEK293T cells two transgene cassettes that constitutively expressed exon 1 of the human RHO gene linked to GFP and exon 1 of the human P23H·RHO gene linked to mscarlet. The modified cells were expanded by serial passage every 3-5 days and maintained in Fibroblast (FB) medium, consisting of Dulbecco's Modified Eagle Medium (DMEM; Corning Cellgro, #10-013-CV) supplemented with 10% fetal bovine serum (FBS; Seradigm, #1500-500), and 100 Units/mL penicillin and 100 mg/mL streptomycin (100×-Pen-Strep; GIBCO #15140-122), and can additionally include sodium pyruvate (100×, ThermoFisher #11360070), non-essential amino acids (100× ThermoFisher #11140050), HEPES buffer (100× ThermoFisher #15630080), and 2-mercaptoethanol (1000× ThermoFisher #21985023). The cells were incubated at 37° C. and 5% CO2. After 1-2 weeks, GFP+/mscarlet+ cells were bulk-sorted into FB medium. The reporter lines were expanded by serial passage every 3-5 days and maintained in FB medium in an incubator at 37° C. and 5% CO2. Reporter clones were generated by a limiting dilution method. The clonal lines were characterized via flow cytometry, genomic sequencing, and functional modification of the RHO locus using a previously validated RHO targeting CasX molecule. The optimal reporter lines were identified as ones that i) had a single copies of WTRHO·GFP and mutRHO·mscarlet correctly integrated per cell, ii) maintained doubling times equivalent to unmodified cells, and iii) resulted in reduction in GFP and mscarlet fluorescence upon disruption of the RHO gene when assayed using the methods described below.

Nucleofection:

AAV cis-plasmids driving expression of the CasX-scaffold-guide system were nucleofected in mNPCs using the Lonza P3 Primary Cell 96-well Nucleofector Kit. For the ARPE-19 line, the Lonza SF solution and supplement was used. Plasmids were diluted to concentrations of 200 ng/µl, 100 ng/µL. 5 µL of DNA per construct was added to the P3 or SF solution containing 200,000 tdTomato mNPCs or ARPE-19 cells respectively. The combined solution was nucleofected using a Lonza 4D Nucleofector System according to manufacturer's guidelines. Following nucleofection, the solution was quenched with appropriate culture media. The solution was then aliquoted in triplicate (approx. 67,000 cells per well) in a 96-well plate. 48 hours after transfection, treated cells were replenished with fresh mNPC media containing growth factors. 5 days after transfection, tdTomato mNPCs were lifted and activity was assessed by FACS.

AAV Production:

Suspension HEK293T cells were adapted from parental HEK293T and grown in FreeStyle 293 media. For screening purposes, small scale cultures (20-30 mL cultured in 125 mL Erlenmeyer flasks and agitated at 110 rpm) were diluted to a density of 1.5e+6 cells/mL on the day of transfection. Endotoxin-free pAAV plasmids with the transgene flanked by ITR repeats were co-transfected with plasmids supplying the adenoviral helper genes for replication and AAV rep/cap genome using PEIMax (Polysciences) in serum-free OPTIMEM media. Cultures were supplemented with 10% CDM4HEK293 (HyClone) 3 hours post-transfection. Three days later, cultures were centrifuged at 1000 rpm for 10 minutes to separate the supernatant from the cell pellet. The supernatant was mixed with 40% PEG 2.5M NaCl (8% final concentration) and incubated on ice for at least 2 hours to precipitate AAV viral particles. The cell pellet, containing the majority of the AAV vectors, was resuspended in lysis media (0.15M NaCl, 50 mM Tris HCl, 0.05% Tween, pH 8.5), sonicated on ice (15 seconds, 30% amplitude) and treated with Benzonase (250 U/µL, Novagen) for 30 minutes at 37° C. Crude lysate and PEG-treated supernatant were then spin at 4000 rpm for 20 minutes at 4° C. to resuspend the PEG precipitated AAV (pellet) with cell debris-free crude lysate (supernatant). clarified further using 0.45 µm filter.

To determine the viral genome titer, 1 µL from crude lysate viruses was digested with DNase and ProtK, followed by quantitative PCR. 5 µL of digested virus was used in a 25 µL qPCR reaction composed of IDT primetime master mix and a set of primer and 6'FAM/Zen/IBFQ probe (IDT) designed to amplify the CMV promoter region (Fwd 5'-CATCTACGTATTAGTCATCGCTATTACCA-3' (SEQ ID NO: 752); Rev 5'-GAAATCCCCGTGAGTCAAACC-3' (SEQ ID NO: 753), Probe 5'-TCAATGGGCGTGGATAG-3'(SEQ ID NO: 754)) or a 62 bp-fragment located in the AAV2-ITR (Fwd 5'-GGAACCCCTAGTGATGGAGTT-3' (SEQ ID NO: 755); Rev 5'-CGGCCTCAGTGAGCGA-3' (SEQ ID NO: 756), Probe 5'-CACTCCCTCTCTGCGCGCTCG-3' (SEQ ID NO: 757)). Ten-fold serial dilutions (50 each of 2e+9 to 2e+4 DNA copies/mL) of an AAV ITR plasmid was used as reference standards to calculate the titer (viral genome (vg)/mL) of viral samples. QPCR program was set up as: initial denaturation step at 95° C. for 5 minutes, followed by 40 cycles of denaturation at 95° C. for 1 min and annealing/extension at 60° C. for 1 min.

Aav Transduction:

10,000 cells/well of mNPCs were seeded on PLF-coated wells in 96-well plates 48-hours before AAV transduction. All viral infection conditions were performed in triplicate, with normalized number of vg among experimental vectors, in a series of 3-fold dilution of multiplicity of infection (MOI) ranging from −1.0e+6 to 1.0e+4 vg/cell. Calculations were based on an estimated number of 20,000 cells per well at the time of transfection. Final volume of 50 µL of AAV vectors diluted in pre-equilibrated mNPC medium supplemented with bFGF/EGF growth factors (20 ng/ml final concentration) were applied to each well. 48 hours post-transfection, complete media change was performed with fresh media supplemented with growth factors. Editing activity (tdt+ cell quantification) was assessed by FACS 5 days post-transfection.

Assessing Editing Activity by FACS:

5 days after transfection, treated tdTomato mNPCs or ARPE-19 cells in 96-well plates were washed with dPBS and treated with 50 µL TrypLE and Trypsin (0.25%) for 15 and 5 minutes respectively. Following cell dissociation, treated wells were quenched with media containing DMEM, 10% PBS and 1× Penicillin/Streptomycin. Resuspended cells were transferred to round-bottom 96-well plates and centrifuged for 5 min at 1000 g. Cell pellets were then resuspended with dPBS containing 1×DAPI, and plates were loaded into an Attune NxT Flow Cytometer Autosampler. The Attune NxT flow cytometer was run using the following gating parameters: FSC-A×SSC-A to select cells, FSC-H×FSC-A to select single cells, FSC-A×VL1-A to select DAPI-negative alive cells, and FSC-A×YL1-A to select tdTomato positive cells.

NGS Analysis of Indels at mRHO Exon 1 Locus:

5 days after transfection, treated tdTomato mNPCs in 96-well plates were washed with dPBS and treated with 50 µL TrypLE and Trypsin (0.25%) for 15 and 5 minutes respectively. Following cell dissociation, treated wells were quenched with media containing DMEM, 10% FBS and 1× penicillin/streptomycin. Cells were then spun down and resulting cell pellets washed with PBS prior to processing them for gDNA extraction using the Zymo mini DNA kit according to the manufacturer's instructions. For assessing editing levels occurring at the mouse RHO exon 1 locus, amplicons were amplified from 200 ng of gDNA with a set of primers (Fwd 5'-ACACTCTTTCCCTA-CACGACGCTCTTCC-GATCTNNNNNNNGCAGCCTTGGTCTCTGT CTACG-3' (SEQ ID NO: 758); Rev 5'-GTGACTGGAGTTCAGACGTGTGCTCTTCC-GATCTGCCCCAGTCTCTCTGCTCATACC-3' (SEQ ID NO: 759)), bead-purified (Beckman coulter, Agencourt Ampure XP) and then re-amplified to incorporate an Illumina adapter sequence and a 16 nt unique molecular identifier (UMI). Quality and quantification of the amplicon was assessed using a Fragment Analyzer DNA analyzer kit (Agilent, dsDNA 35-1500 bp) Amplicons were sequenced on the Illumina Miseq™ according to the manufacturer's instructions. Raw fastq files from sequencing were processed as follows: (1) the sequences were trimmed for quality and for adapter sequences using the program cutadapt (v. 2.1); (2) the sequences from read 1 and read 2 were merged into a single insert sequence using the program flash2 (v2.2.00); and (3) the consensus insert sequences were run through the program CRISPResso2 (v 2.0.29), along with the expected amplicon sequence and the spacer sequence. This program quantifies the percent of reads that were modified in a window around the 3' end of the spacer (30 bp window centered at −3 bp from 3' end of spacer). CasX activity was quantified as the total percent of reads that contain insertions, substitutions and/or deletions anywhere within this window.

Figure 14:
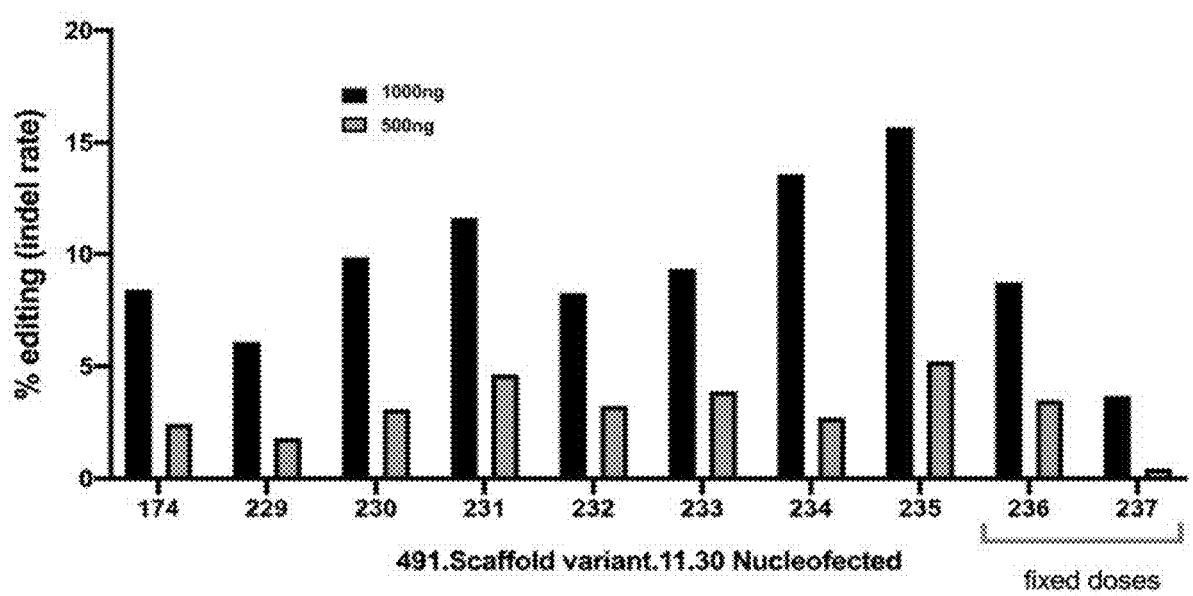
FIG. 14 shows the results of an editing assay comparing gRNA scaffolds 229-237 to scaffold 174 in mouse neural progenitor cells (mNPC) isolated from the Ai9-tdtomato transgenic mice, as described in Example 21. Cells were nucleofected with the indicated doses of p59 plasmids encoding CasX 491, the scaffold, and spacer 11.30 (5' AAGGGGCUCCGCACCACGCC 3', SEQ ID NO: 17) targeting mRHO. Editing at the mRHO locus was assessed 5 days post-transfection by NGS, and show that editing with constructs with scaffolds 230, 231, 234 and 235 demonstrated greater editing compared to constructs with scaffold 174 at both doses.
Figure 15:
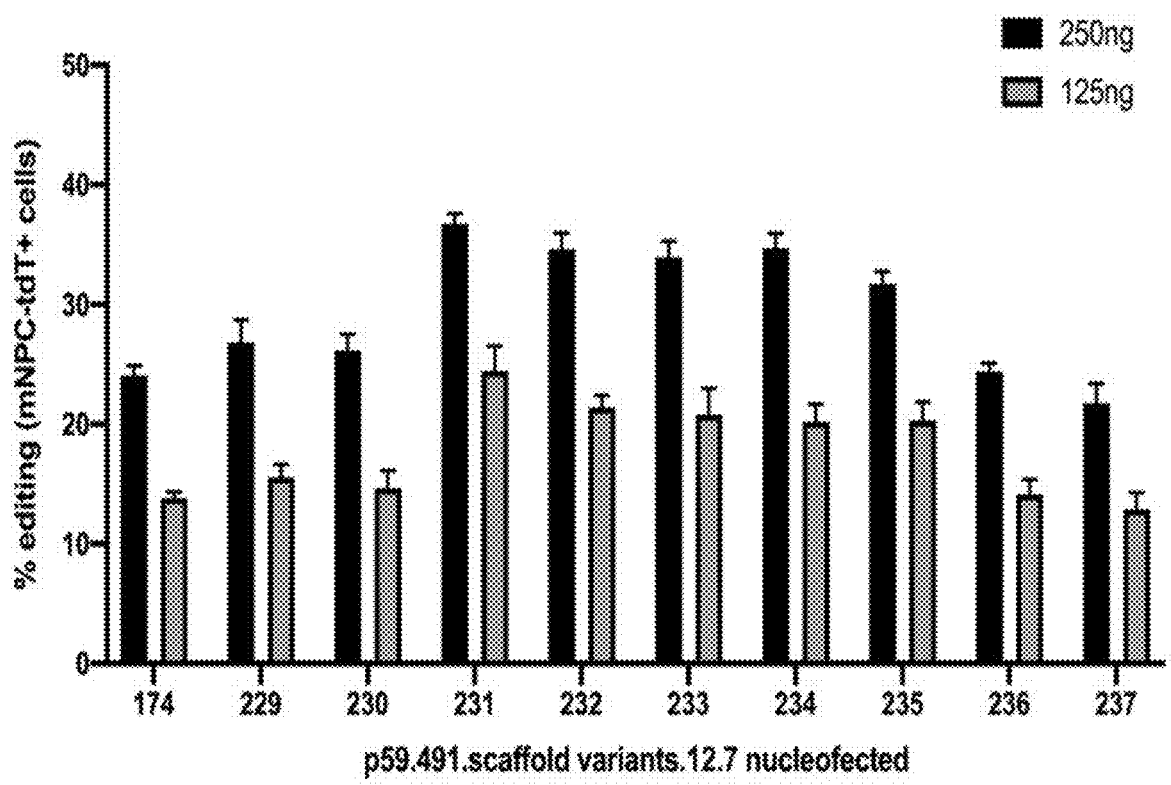
FIG. 15 shows the results of an editing assay comparing gRNA scaffolds 229-237 to scaffold 174 in mNPC cells, as described in Example 21. Cells were nucleofected with the indicated doses of p59 plasmids encoding CasX 491, the scaffold, and spacer 12.7 (5' CUGCAUUCUAGUUGUG-GUUU 3', SEQ ID NO: 1146) targeting repeat elements preventing expression of the tdTomato fluorescent protein. Editing was assessed 5 days post-transfection by FACS, to quantify the fraction of tdTomato positive cells. Cells nucleofected with scaffolds 231-235 displayed approximately 35% greater editing compared to constructs with scaffold 174 at the high dose, and approximately 25% greater editing at the low dose.

Results:

Different editing experiments were conducted to quantify on-target cleavage mediated by CasX 491 paired with novel gRNA scaffold variants (guides 174 & 229-237) with different spacers targeting multiple genomic loci of interest. Constructs were cloned into the AAV backbone p59, flanked by ITR2 sequences, driving expression of the protein Cas 491 under the control of a CMV promoter, as well the scaffold-spacer under the control of the human U6 promoter. The mNPC-tdT reporter cell lines was used to assess the dual-cut efficiency mediated by a single spacer at the tdTomato locus (spacer 12.7, TTC PAM), as well as the single cut efficiency at the endogenous mouse RHO exon 1 locus (spacer 11.30, CTCN PAM). A dual reporter system integrated in an ARPE-19 derived cell line was also used to assess on-target editing at the exogenously expressed human WT Rho locus (spacers 11.1, CTC PAM).

gRNA scaffold variants with spacers 12.7 and 11.30 were tested via nucleofection in the mouse NPC cell line at two different doses indicated in FIG. 14 and FIG. 15 respectively. Constructs were compared to the current benchmark gRNA scaffold 174 activity. At both targeted loci, constructs of guide scaffold variants 231, 233, 234, and 235 performed at higher levels than the construct containing scaffold 174. Scaffold 235 displayed a 2-fold increase in activity at mRHO exon 1 locus compared to scaffold 174. We further validated that scaffold 235 consistently improved activity without increased off-target cleavage by nucleofecting dual reporter ARPE-19 cell line with construct p59.491.174.11.1 and p59.491.235.11.1 as well as a non-target spacer control. Spacer 11.1 was targeting the exogenously expressed mRHO-GFP gene. Scaffold 235 displayed 3-fold increased activity compared to 174 (9% vs 3% of Rho-GFP-cells, respectively). Allele-specificity was assessed by looking at percent of P23H-RHO-Scarlett-cell population, which sequence differs from WT by 1 bp.

Finally, we sought to demonstrate that these scaffold variants packaged efficiently in AAV and remained potent when delivered virally. mNPC transduced with AAV vectors expressing guide scaffold variants 174 and 235 with spacer 11.30 (on target, mouse WT RHO) and 11.31 (off-target, mouse P23 RHO) showed increased activity of constructs containing the 235 scaffold variant compared to scaffold 174 at on-target locus (>5-fold increase, FIGS. 45A and B) at 3.0e+5 MOI while no off-target indels were detectable.

The results support that scaffold variants with novel structural mutations can be engineered with increased activity in dual reporter systems with therapeutically-relevant genomic targets such as mouse and human RHO exon 1 loci. Furthermore, while the newly-characterized scaffold displayed an overall >2-fold increase in activity, no off-target cleavage with 1-bp mismatch spacer region was detected. This is relevant for allele-specific therapeutic strategy such as adRP P23H Rho, which mutated allele differs from WT sequence by 1 nucleotide, targeted by spacer 11.31. This study further validates the use of guide scaffold 235 in AAV vectors designed for P23H RHO rescue and genotoxic studies, as well as for other therapeutic targets.

Example 22: Demonstration that Catalytically-Dead CasX does not Edit at the Endogenous B2M Locus In Vitro Experiments will be performed to demonstrate that catalytically-dead CasX is unable to edit the endogenous gene beta-2-microglobulin (B2M) in vitro.

Materials and Methods:

Generation of Catalytically-Dead CasX (dCasX) Constructs and Cloning:

CasX variant 491, 527, 668 and 676 with scaffold variant 1:14 will be used in these experiments. A positive control of Cas9 and an appropriate guide will also be included. To generate catalytically-dead CasX 491 (dCasX491; CAS096; SEQ ID NO: 1107) and catalytically-dead CasX 527 (dCasX527; CAS142; SEQ ID NO: 1109), D659, E756, D921 catalytic residues of the RuvC domain of CasX variant 491, and D660, E757, and D922 catalytic residues of the RuvC domain of CasX variant 527 will be mutated to alanine to abolish the endonuclease activity. Similarly, D660, E757, D923-to-alanine mutations at catalytic residues within the RuvC domain of CasX variants 668 and 676 will be designed to generate catalytically-dead CasX 668 (dCasX668; CAS401; SEQ ID NO: XX) and catalytically-dead CasX 676 (dCasX676; CAS402; SEQ ID NO: XX). The resulting plasmids (dCasX variant amino acid sequences listed in Table 7) will contain constructs with the following configuration: Ef1α-SV40NLS-dCasX variant-SV40NLS. Plasmids will also contain sequences encoding a gRNA scaffold variant 174 having either a spacer (spacer. 7.37; GGCCGAGAUGUCUCGCUCCG, SEQ ID NO: 1105) targeting the endogenous B2M locus or a non-targeting control (spacer 0.0; CGAGACGUAAUUACGUCUCG; SEQ ID NO: 1106).

Constructs containing sequences coding for dCasX491, dCasX527, dCasX668, and dCasX676 will be ordered as oligonucleotides and assembled by overlap extension PCR followed by isothermal assembly to build plasmids encoding for the catalytically-dead CasX variants. Following isothermal assembly, resulting plasmids will be transformed into chemically competent E. coli cells, which will be plated on kanamycin LB-agar plates following recovery at 37° C. for 1 hour. Single colonies will be picked for colony PCR and Sanger-sequencing. Sequence-validated constructs will be midi-prepped for subsequent transfection into HEK293T cells.

Plasmid Transfection into HEK293T Cells:

HEK293T cells will be seeded at a density of 30,000 cells in each well of a 96-well plate. The next day, each well will be transiently transfected using Lipofectamine™ with 100 ng of catalytically-dead variant plasmid containing a CasX: gRNA construct encoding for CasX variant 491, dCasX491, dCasX527, dCasX668, or dCasX676 (sequences in Table 7), with the gRNA having either non-targeting spacer 0.0 or targeting spacer 7.37 to the B2M locus. Each construct will be tested in triplicate. 24 hours post-transfection, cells will be selected with 2 µg/mL puromycin. Six days after transfection, cells will be harvested for editing analysis by next-generation sequencing (NGS) and B2M protein expression analysis via B2M immunostaining followed by flow cytometry. Expression of B2M will be determined by using an antibody (BioLegend) that will detect the B2M-dependent HLA protein expressed on the cell surface. HLA+ cells will be measured using the Attune NxT flow cytometer.

NGS Processing and Analysis:

Genomic DNA (gDNA) from harvested cells will be extracted using the Zymo Quick-DNA Miniprep Plus kit following the manufacturer's instructions. Target amplicons will be formed by amplifying regions of interest from 200 ng of extracted gDNA with a set of primers specific to the human B2M locus. These gene-specific primers contain an additional sequence at the 5' end to introduce an Illumina adapter and a 16-nucleotide unique molecule identifier. Amplified DNA products will be purified with the Ampure XP DNA cleanup kit. Quality and quantification of the amplicon will be assessed using a Fragment Analyzer DNA Analysis kit (Agilent, dsDNA 35-1500 bp) Amplicons will be sequenced on the Illumina Miseg™ according to the manufacturer's instructions. Raw fastq files from sequencing will be quality-controlled and processed using cutadapt v2.1, flash2 v2.2.00, and CRISPResso2 v2.0.29. Each sequence will be quantified for containing an insertion or deletion (indel) relative to the reference sequence, in a window around the 3' end of the spacer (30 bp window centered at −3 bp from 3' end of spacer). CasX activity will be quantified as the total percent of reads that contain insertions, substitutions, and/or deletions anywhere within this window for each sample.

Results:

The experiments are expected to demonstrate editing at the B2M locus mediated by catalytically-active CasX 491, which will result in reduced B2M protein expression. On the other hand, neither dCasX491, dCasX527, dCasX668, nor dCasX676 are expected to show editing at the B2M locus. Given the anticipated steric hindrance of the catalytically-dead CasX molecule at the transcription start site of the B2M locus, a slight repression in B2M protein expression is expected with either enzymatically-inactive CasX molecule.

Example 23: Improving MS2 Hairpin Binding Affinity Enhances XDP Editing Potency

Experiments were conducted to determine whether editing potency of XDPs could be improved using a recruitment strategy whereby the gRNA of the CasX:gRNA RNP complex contains a functionalized RNA extended stem with an MS2 hairpin having high affinity for a Gag-MS2 RNA-binding protein (RBP). Binding of the RNA hairpin to the MS2 RBP enables recruitment of the CasX RNP cargo to the XDP particle. Upon delivery of the XDP to the target cell for editing, this RNA hairpin-MS2 RBP is expected to dissociate, allowing CasX to translocate to the nucleus. Thus, increasing the stability of the MS2 protein-RNA complex supports XDP formation, which may be achieved by changing the MS2 RNA-binding protein or RNA hairpin sequences to increase the binding affinity between these components.

To explore this principle further, gRNAs incorporating RNA hairpin variants with varying affinities for the MS2 RBP were evaluated using a high-throughput, in vitro biochemical assay to assess equilibrium binding and dissociation kinetics (Buenrostro et al., Quantitative analysis of RNA-protein interactions on a massively parallel array reveals biophysical and evolutionary landscapes. Nat Biotechnol. 32(6):562 (2014)). gRNA hairpin variants and their associated $K_D$ (dissociation constant) values are listed in Table 34; sequences of the guide plasmids encoding the different MS2 RNA hairpin variants are provided in Table 35 and the sequences of the MS2 hairpins are provided in Table 36. Experiments were conducted to investigate whether gRNAs containing MS2 hairpin variants with improved binding affinity would enhance XDP formation or editing potency. Specifically, multiple MS2 hairpin variants with varying equilibrium binding affinities were assessed for their effects on XDP potency and titer. Several non-binding variants were also included in these experiments.

TABLE 34 gRNA scaffolds containing MS2 hairpin variants with varying affinities and their dissociation constant values ($K_D$). Specific positions for the indicated nucleotide mutations refer to the positions of the base MS2 hairpin (scaffold 188) depicted in FIG. 48

| Scaffold No. | Positions of indicated nucleotide changes within MS2 hairpin (scaffold 188) | $K_D$ (nM) | $K_{OFF}$ (1/s) | $-\Delta\log(K_{OFF})/-\Delta\Delta G$ |
|---|---|---|---|---|
| High affinity MS2 hairpin variants ||||| 
| 188 | | 2.558 | 0.001 | |
| 251 | | 2.558 | | |
| 296 | −13C, 1G | 1.881 | 0.001 | 0.510 |
| 297 | −15G, 3C | 2.112 | 0.001 | 0.062 |
| 298 | −15G, −13C, 1G, 3C | | | |
| 299 | −15G, −13C, −8C, −3G, 1G, 3C | | | |
| 300 | −8C, −3G | 2.686 | 0.002 | >1 |

TABLE 34-continued gRNA scaffolds containing MS2 hairpin variants with varying affinities and their dissociation constant values ($K_D$). Specific positions for the indicated nucleotide mutations refer to the positions of the base MS2 hairpin (scaffold 188) depicted in FIG. 48

| Scaffold No. | Positions of indicated nucleotide changes within MS2 hairpin (scaffold 188) | $K_D$ (nM) | $K_{OFF}$ (1/s) | $-\Delta\log(K_{OFF})/-\Delta\Delta G$ |
|---|---|---|---|---|
| Medium-high affinity MS2 hairpin variants | | | | |
| 304 | −13U | 9.346 | 0.002 | 0.286 |
| 307 | −11U, −1A | 9.226 | 0.003 | 0.579 |
| 313 | −6C | 9.274 | 0.002 | 0.400 |
| Medium affinity MS2 hairpin variants | | | | |
| 301 | −8U, −3A | 34.084 | 0.007 | 0.654 |
| 303 | −15C, −13U | | 0.002 | 0.089 |
| 305 | −13C | 17.634 | 0.002 | 0.163 |
| 306 | −1U | | 0.015 | 0.854 |
| 310 | −5U | 36.912 | 0.016 | 0.910 |
| 314 | −14G, 3G | | 0.002 | 0.120 |
| Medium-low affinity MS2 hairpin variants | | | | |
| 308 | −11U, −1G | 77.562 | 0.018 | 0.754 |
| Low affinity MS2 hairpin variants | | | | |
| 309 | −11U, −1U | 453.563 | N/A | N/A |
| 311 | −5A | 415.477 | N/A | N/A |
| 302 | −8A, −3G | 1489.244 | N/A | N/A |
| No affinity MS2 hairpin variants | | | | |
| 312 | −5G | 12506.440 | N/A | N/A |
| 315 | −10G | 18018.92728 | N/A | N/A |

TABLE 35

Sequences of XDP plasmids

| Plasmid ID | Description | DNA Sequence or SEQ ID NO |
|---|---|---|
| pXDP161 | Gag-(-1)-PR | 1111 |
| pXDP164 | Gag-MS2 | 1112 |
| pXDP353 | Gag-MS2(N55K) | 1113 |
| pXDP344 | CasX 491 NLS 240 | 1114 |
| pSG50 | Scaffold 188 | ACTGGCGCTTTTATCTGATTACTTTGAGAGCCATCACCAGCGACTATGTCGTAGTGGGTAAAGCTCACATGAGGATCACCCATGTGAGCATCAAAGCTGCATTCTAGTTGTGGTTT (SEQ ID NO: 1115) |
| pSG73 | Scaffold 251 | ACTGGCGCTTTTATCTGATTACTTTGAGAGCCATCACCAGCGACTATGTCGTAGTGGGTAAAGCTGCACTATGGGCGCAGCTCATGAGGATCACCCATGAGCTGACGGTACAGGCCACATGAGGATCACCCATGTGGTATAGTGCAGCATCAAAGCTGCATTCTAGTTGTGGTTT (SEQ ID NO: 1116) |
| pSG170 | Scaffold 296 | ACTGGCGCTTTTATCTGATTACTTTGAGAGCCATCACCAGCGACTATGTCGTAGTGGGTAAAGCTCACCTGAGGATCACCCAGGTGAGCATCAAAGCTGCATTCTAGTTGTGGTTTTTTTTT (SEQ ID NO: 1117) |
| pSG171 | Scaffold 297 | ACTGGCGCTTTTATCTGATTACTTTGAGAGCCATCACCAGCGACTATGTCGTAGTGGGTAAAGCTCGCATGAGGATCACCCATGCGAGCATCAAAGCTGCATTCTAGTTGTGGTTTTTTTTT (SEQ ID NO: 1118) |
| pSG172 | Scaffold 298 | ACTGGCGCTTTTATCTGATTACTTTGAGAGCCATCACCAGCGACTATGTCGTAGTGGGTAAAGCTCGCCTGAGGATCACCCAGGCGAGCATCAAAGCTGCATTCTAGTTGTGGTTTTTTTTT (SEQ ID NO: 1119) |
| pSG173 | Scaffold 299 | ACTGGCGCTTTTATCTGATTACTTTGAGAGCCATCACCAGCGACTATGTCGTAGTGGGTAAAGCTCGCCTGAGCATCAGCCAGGCGAGCATCAAAGCTGCATTCTAGTTGTGGTTTTTTTTT (SEQ ID NO: 1120) |

TABLE 35-continued

Sequences of XDP plasmids

| Plasmid ID | Description | DNA Sequence or SEQ ID NO |
|---|---|---|
| pSG174 | Scaffold 300 | ACTGGCGCTTTTATCTGATTACTTTGAGAGCCATCACCAGCGACTATGTCGT AGTGGGTAAAGCTCACATGAGCATCAGCCATGTGAGCATCAAAGCTGCATTC TAGTTGTGGTTTTTTTTT (SEQ ID NO: 1121) |
| pSG175 | Scaffold 301 | ACTGGCGCTTTTATCTGATTACTTTGAGAGCCATCACCAGCGACTATGTCGT AGTGGGTAAAGCTCACATGAGTATCAACCATGTGAGCATCAAAGCTGCATTC TAGTTGTGGTTTTTTTTT (SEQ ID NO: 1122) |
| pSG176 | Scaffold 302 | ACTGGCGCTTTTATCTGATTACTTTGAGAGCCATCACCAGCGACTATGTCGT AGTGGGTAAAGCTCACATGAGAATCAGCCATGTGAGCATCAAAGCTGCATTC TAGTTGTGGTTTTTTTTT (SEQ ID NO: 1123) |
| pSG177 | Scaffold 303 | ACTGGCGCTTTTATCTGATTACTTTGAGAGCCATCACCAGCGACTATGTCGT AGTGGGTAAAGCTCCCTTGAGGATCACCCATGTGAGCATCAAAGCTGCATTC TAGTTGTGGTTTTTTTTT (SEQ ID NO: 1124) |
| pSG178 | Scaffold 304 | ACTGGCGCTTTTATCTGATTACTTTGAGAGCCATCACCAGCGACTATGTCGT AGTGGGTAAAGCTCACTTGAGGATCACCCATGTGAGCATCAAAGCTGCATTC TAGTTGTGGTTTTTTTTT (SEQ ID NO: 1125) |
| pSG179 | Scaffold 305 | ACTGGCGCTTTTATCTGATTACTTTGAGAGCCATCACCAGCGACTATGTCGT AGTGGGTAAAGCTCACCTGAGGATCACCCATGTGAGCATCAAAGCTGCATTC TAGTTGTGGTTTTTTTTT (SEQ ID NO: 1126) |
| pSG180 | Scaffold 306 | ACTGGCGCTTTTATCTGATTACTTTGAGAGCCATCACCAGCGACTATGTCGT AGTGGGTAAAGCTCACATGAGGATCACCTATGTGAGCATCAAAGCTGCATTC TAGTTGTGGTTTTTTTTT (SEQ ID NO: 1127) |
| pSG181 | Scaffold 307 | ACTGGCGCTTTTATCTGATTACTTTGAGAGCCATCACCAGCGACTATGTCGT AGTGGGTAAAGCTCACATTAGGATCACCAATGTGAGCATCAAAGCTGCATTC TAGTTGTGGTTTTTTTTT (SEQ ID NO: 1128) |
| pSG182 | Scaffold 308 | ACTGGCGCTTTTATCTGATTACTTTGAGAGCCATCACCAGCGACTATGTCGT AGTGGGTAAAGCTCACATTAGGATCACCGATGTGAGCATCAAAGCTGCATTC TAGTTGTGGTTTTTTTTT (SEQ ID NO: 1129) |
| pSG183 | Scaffold 309 | ACTGGCGCTTTTATCTGATTACTTTGAGAGCCATCACCAGCGACTATGTCGT AGTGGGTAAAGCTCACATTAGGATCACCTATGTGAGCATCAAAGCTGCATTC TAGTTGTGGTTTTTTTTT (SEQ ID NO: 1130) |
| pSG184 | Scaffold 310 | ACTGGCGCTTTTATCTGATTACTTTGAGAGCCATCACCAGCGACTATGTCGT AGTGGGTAAAGCTCACATGAGGATTACCCATGTGAGCATCAAAGCTGCATTC TAGTTGTGGTTTTTTTTT (SEQ ID NO: 1131) |
| pSG185 | Scaffold 311 | ACTGGCGCTTTTATCTGATTACTTTGAGAGCCATCACCAGCGACTATGTCGT AGTGGGTAAAGCTCACATGAGGATAACCCATGTGAGCATCAAAGCTGCATTC TAGTTGTGGTTTTTTTTT (SEQ ID NO: 1132) |
| pSG186 | Scaffold 312 | ACTGGCGCTTTTATCTGATTACTTTGAGAGCCATCACCAGCGACTATGTCGT AGTGGGTAAAGCTCACATGAGGATGACCCATGTGAGCATCAAAGCTGCATTC TAGTTGTGGTTTTTTTTT (SEQ ID NO: 1133) |
| pSG187 | Scaffold 313 | ACTGGCGCTTTTATCTGATTACTTTGAGAGCCATCACCAGCGACTATGTCGT AGTGGGTAAAGCTCACATGAGGACCACCCATGTGAGCATCAAAGCTGCATTC TAGTTGTGGTTTTTTTTT (SEQ ID NO: 1134) |
| pSG188 | Scaffold 314 | ACTGGCGCTTTTATCTGATTACTTTGAGAGCCATCACCAGCGACTATGTCGT AGTGGGTAAAGCTCAGATGAGGATCACCCATGGGAGCATCAAAGCTGCATTC TAGTTGTGGTTTTTTTTT (SEQ ID NO: 1135) |
| pSG189 | Scaffold 315 | ACTGGCGCTTTTATCTGATTACTTTGAGAGCCATCACCAGCGACTATGTCGT AGTGGGTAAAGCTCACATGGGGATCACCCATGTGAGCATCAAAGCTGCATTC TAGTTGTGGTTTTTTTTT (SEQ ID NO: 1136) |

TABLE 36

MS2 hairpin variant sequences

| Scaffold No. | M52 Sequences | SEQ ID NO |
|---|---|---|
| 188 251 | ACAUGAGGAUCACCCAUGU | 1137 |
| 296 | ACCUGAGGAUCACCCAGGU | 1138 |
| 297 | GCAUGAGGAUCACCCAUGC | 1139 |
| 298 | GCCUGAGGAUCACCCAGGC | 1140 |
| 299 | GCCUGAGCAUCAGCCAGGC | 1141 |
| 300 | ACAUGAGCAUCAGCCAUGU | 1142 |
| 304 | ACUUGAGGAUCACCCAUGU | 1143 |
| 307 | ACAUUAGGAUCACCAAUGU | 1144 |
| 313 | ACAUGAGGACCACCCAUGU | 1145 |

Materials and Methods:

All plasmids encoding CasX proteins pertain to CasX variant 491. All XDPs were pseudotyped with 10% VSV-G (percentage of VSV-G plasmid relative to other XDP structural plasmids). RNA fold structures were generated with RNAfold web server and VARNA software. The methods to produce XDPs are described herein, as well as in WO2021113772A1, incorporated by reference in its entirety.

Structural Plasmid Cloning:

Briefly, to generate the XDP structural plasmids, the Gag-pol sequence was removed from pXDP1 (UC Berkeley), and amplified and purified fragments encoding CasX 491, HIV-1, or MS2 CP components were cloned into plasmid backbones using the In-Fusion HD Cloning Kit (Takara) following the manufacturer's protocols. Assembled products were transformed into chemically-competent Turbo Competent *E. coli* cells, plated on LB-Agar plates containing ampicillin following recovery at 37° C. Individual colonies were picked, miniprepped, and Sanger-sequenced for assembly verification. Plasmid sequences are listed in Table 35.

Guide Plasmid Cloning:

All guide plasmids containing MS2 RNA hairpin variants incorporated the tdTomato targeting spacer 12.7 (CUG-CAUUCUAGUUGUGGUUU; SEQ ID NO: 1146). The tdTomato targeting spacer was cloned as previously described. Briefly, the spacer was made by annealing two oligos and cloned via Golden Gate assembly with the appropriate restriction enzymes into a pSG plasmid with an alternate scaffold. Cloned spacers were subjected to transformation, mini-prepping, and Sanger-sequencing for verification.

pGP2 Glycoprotein Plasmid Cloning:

Briefly, sequences encoding the VSV-G glycoprotein and CMV promoter and the backbone taken from a kanamycin-resistant plasmid were amplified and purified as previously described. These constructs were cloned into plasmid backbones using the In-Fusion® HD Cloning Kit (Takara) following the manufacturer protocols. Assembled products were transformed into chemically-competent Turbo Competent *E. coli* cells, plated on LB-Agar plates containing kanamycin and incubated at 37° C. Individual colonies were picked, miniprepped, and Sanger-sequenced for assembly verification.

XDP Production:

Briefly, HEK293T Lenti-X cells were seeded in 15 cm dishes at $20 \times 10^6$ cells per dish 24 hours before transfection to reach 70-90% confluency. The next day, Lenti-X cells were transfected with the following plasmids using PEI Max (Polypus): XDP structural plasmids (also encoding the CasX variants), guide plasmid variants, and pGP2 for XDP pseudotyping. 24 hours post-transfection, media was replaced with Opti-MEM (Thermo Fisher). XDP-containing media was collected 72 hours post-transfection and filtered through a 0.45 μm PES filter. The supernatant was concentrated and purified via centrifugation. XDPs were resuspended in 500 μL of DMEM/F12 supplemented with Glutamax, HEPES, NEAA, Pen/Strep, 2-mercaptoethanol, B-27 without vitamin A, and N2.

XDP Transduction of tdTomato Neural Progenitor Cells (NPCs):

tdTomato NPCs were grown in DMEM/F12 supplemented with Glutamax, HEPES, NEAA, Pen/Strep, 2-mercaptoethanol, B-27 without vitamin A, and N2. Cells were harvested using StemPro Accutase Cell Dissociation Reagent and seeded on PLF-coated 96-well plates. 48 hours later, cells were transduced with XDPs containing tdTomato targeting spacer, starting with a neat resuspended virus and proceeding through 5 half-log dilutions. Cells were then centrifuged for 15 minutes at 1000×g. Transduced NPCs were grown for 96 hours before analyzing tdTomato fluorescence by flow cytometry as a marker of editing at the tdTomato locus, with the EC50 determined as the number of XDP particles needed to achieve editing in 50% of the cells, as determined by flow cytometry. Assays were run 2-3 times for each sample with similar results.

Results:

XDPs composed of Gag-MS2, Gag-pro, CasX, gRNA scaffold variants, and VSV-G were produced either with the original MS2 (MS2 WT) or an MS2 high affinity variant (MS2 353). Produced XDPs were subsequently assessed for their editing efficiency at the tdTomato locus in NPCs. FIG. 49 shows the percent editing at the tdTomato locus as measured by tdTomato fluorescence using flow cytometry when 0.007 μL of concentrated XDP preps were used to transduce NPCs. In addition to the base control gRNA scaffolds 188 and 251, high affinity scaffold variants 296 and 298 demonstrated enhanced potency with both MS2 WT and MS2 353, with $K_D$ values ranging from 1.8 to 2.1 nM. Furthermore, medium affinity scaffold variants 303, 304, 305, 307, 310 and 313, with $K_D$ values ranging from 9.2 to 36.9 nM, resulted in promising editing efficiencies. FIG. 50 illustrates EC50 results across the different gRNA scaffolds incorporating the MS2 WT and MS 353 configurations. Scaffold variants 296, 297, and 305 exhibited a slightly higher potency compared to scaffold 188, an advantage that was more evident with the MS2 353 configuration. FIG. 51 shows a clear correlation between the affinity ($K_D$) of the gRNA MS2 hairpin and resulting XDP potency (EC50), with an $R^2$ value of 0.81 (p<0.001). XDP comprising MS2 having an affinity of <35 nM resulted in efficient recruitment and packaging of the CasX RNP into XDPs. However, under the conditions of these experiments, there was no correlation observed between the affinity ($K_D$) of the gRNA MS2 hairpin and resulting XDP titer (FIG. 52).

SEQUENCE LISTING (2398 sequences)

SEQ ID NO: 1 - protein, 986 aa, Unknown
  Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, Unknown
  Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, Unknown
  Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - RNA, 108 nt, Artificial Sequence
  reference sgRNA
acaucuggcgcguuuauuccauuacuuuggagccagucccagcgacuaugucguauggacgaagcgcuuauuuaucggagagaaaccgauaaguaaaacgcaucaaag

SEQ ID NO: 5 - RNA, 108 nt, Artificial Sequence
  reference sgRNA
uacuggcgcuuuuaucucauuacuuugagagccaucaccagcgacuaugucguauggguaaagcgcuuauuuaucggagagaaauccgauaaauaagaagcaucaaag

SEQ ID NO: 6 - RNA, 81 nt, Artificial Sequence
  tracrRNA sequence
acaucuggcgcguuuauuccauuacuuuggagccagucccagcgacuaugucguauggacgaagcgcuuauuuaucggaga

SEQ ID NO: 7 - RNA, 78 nt, Artificial Sequence
  tracrRNA sequence
acaucuggcgcguuuauuccauuacuuuggagccagucccagcgacuaugucguauggacgaagcgcuuauuuaucgg

SEQ ID NO: 8 - RNA, 80 nt, Artificial Sequence
  tracrRNA sequence
uacuggcgcuuuuaucucauuacuuugagagccaucaccagcgacuaugucguauggguaaagcgcuuauuuaucggaga

SEQ ID NO: 9 - RNA, 77 nt, Artificial Sequence
  tracrRNA sequence
uacuggcgcuuuuaucucauuacuuugagagccaucaccagcgacuaugucguauggguaaagcgcuuauuuaucgg

SEQ ID NO: 10 - RNA, 25 nt, Artificial Sequence
  tracrRNA sequence
guuuacacacucccucucauagggu

SEQ ID NO: 11 - RNA, 25 nt, Artificial Sequence
  tracrRNA sequence
guuuacacacucccucucaugaggu

SEQ ID NO: 12 - RNA, 25 nt, Artificial Sequence
  tracrRNA sequence
uuuuacauacccccucucaugggau

SEQ ID NO: 13 - RNA, 25 nt, Artificial Sequence
  tracrRNA sequence
guuuacacacucccucucauggggg

SEQ ID NO: 14 - RNA, 20 nt, Artificial Sequence
  reference sgRNA
ccagcgacuaugucguaugg

SEQ ID NO: 15 - RNA, 39 nt, Artificial Sequence
  extended stem loop
gcgcuuauuuaucggagagaaauccgauaaauaagaagc

SEQ ID NO: 16 - RNA, 74 nt, Artificial Sequence
  reference sgRNA
ggcgcuuuuaucucauuacuuugagagccaucaccagcgacuaugucguauggguaaagcgcuuauuuaucgga

SEQ ID NO: 17 - RNA, 20 nt, Artificial Sequence
  spacer sequence
aaggggcuccgcaccacgcc

SEQ ID NO: 18 - RNA, 20 nt, Artificial Sequence
  spacer sequence
aaggggcugcguaccacacc

SEQ ID NO: 19 - DNA, 47 bp, Artificial Sequence
  TTC protospacer adjacent motif
  misc_feature (1)..(2): n is any nucleotide
  misc_feature (6)..(47): n is any nucleotide
  misc_feature (21)..(41): individual nucleotides may be absent
nnttcnnnnnnnnnnnnnnnnnnnnnnnnnnnnnnnnnnnnnnnnnn

SEQ ID NO: 20 - DNA, 47 bp, Artificial Sequence
  CTC protospacer adjacent motif
  misc_feature (1)..(2): n is any nucleotide
  misc_feature (6)..(47): n is any nucleotide
  misc_feature (21)..(41): individual nucleotides may be absent
nnctcnnnnnnnnnnnnnnnnnnnnnnnnnnnnnnnnnnnnnnnnnn

SEQ ID NO: 21 - DNA, 47 bp, Artificial Sequence
  GTC protospacer adjacent motif
  misc_feature (1)..(2): n is any nucleotide
  misc_feature (6)..(47): n is any nucleotide
  misc_feature (21)..(41): individual nucleotides may be absent
nngtcnnnnnnnnnnnnnnnnnnnnnnnnnnnnnnnnnnnnnnnnnn

SEQ ID NO: 22 - DNA, 47 bp, Artificial Sequence
  ATC protospacer adjacent motif
  misc_feature (1)..(2): n is any nucleotide
  misc_feature (6)..(47): n is any nucleotide
  misc_feature (21)..(41): individual nucleotides may be absent
nnatcnnnnnnnnnnnnnnnnnnnnnnnnnnnnnnnnnnnnnnnnnn

SEQ ID NO: 23 - DNA, 47 bp, Artificial Sequence
  TC protospacer adjacent motif
  misc_feature (1)..(3): n is any nucleotide
  misc_feature (6)..(47): n is any nucleotide
  misc_feature (21)..(41): individual nucleotides may be absent
nnntcnnnnnnnnnnnnnnnnnnnnnnnnnnnnnnnnnnnnnnnnnn

SEQ ID NO: 24 - protein, 4 aa, Artificial Sequence
  linker polypeptide
PPPG

SEQ ID NO: 25 - protein, 23 aa, Artificial Sequence
  linker polypeptide
  SITE (8)..(11): grouped amino acid residues may be present or absent
  SITE (12)..(15): grouped amino acid residues may be present or absent
  SITE (16)..(19): grouped amino acid residues may be present or absent
  SITE (20)..(23): grouped amino acid residues may be present or absent
PPPGGGSGGGSGGGSGGGSGGGS

SEQ ID NO: 26 - protein, 23 aa, Artificial Sequence
  linker polypeptide
  SITE (1)..(4): grouped amino acid residues may be present or absent
  SITE (5)..(8): grouped amino acid residues may be present or absent
  SITE (9)..(12): grouped amino acid residues may be present or absent
  SITE (13)..(16): grouped amino acid residues may be present or absent
GGGSGGGSGGGSGGGSGGGSPPP

SEQ ID NO: 27 - protein, 12 aa, Artificial Sequence
  linker polypeptide
TPPKTKRKVEFE

SEQ ID NO: 28 - DNA, 60 bp, Artificial Sequence
  in vitro cleavage assay target
tgaagctgacagcattcgggccgagatgtctcgctccgtggccttagctgtgctcgcgct

SEQ ID NO: 29 - DNA, 20 bp, Artificial Sequence
  spacer sequence
tgtggtcggggtagcggctg

SEQ ID NO: 30 - DNA, 20 bp, Artificial Sequence
  spacer sequence
tcaagtccgccatgcccgaa

SEQ ID NO: 31 - RNA, 19 nt, Unknown
  exogenous stem loop region
acaugaggauuacccaugu

SEQ ID NO: 32 - RNA, 18 nt, Unknown
  exogenous stem loop region
ugcaugucuaagacagca

SEQ ID NO: 33 - RNA, 20 nt, Unknown
  exogenous stem loop region
aauccauugcacuccggauu

SEQ ID NO: 34 - RNA, 12 nt, Unknown
  exogenous stem loop region
ccucuucggagg

SEQ ID NO: 35 - RNA, 21 nt, Unknown
  exogenous stem loop region
aggaguuucuauggaaacccu

SEQ ID NO: 36 - RNA, 30 nt, Unknown
  exogenous stem loop region
aggugggacgaccucucggucguccuaucu

SEQ ID NO: 37 - RNA, 19 nt, Unknown
  exogenous stem loop region
ugcucgcuccguucgagca

SEQ ID NO: 38 - RNA, 21 nt, Unknown
  exogenous stem loop region
ugcucgacgcguccucgagca

SEQ ID NO: 39 - RNA, 22 nt, Unknown
  exogenous stem loop region
ugcucguuugcggcuacgagca

SEQ ID NO: 40 - RNA, 17 nt, Unknown
  exogenous stem loop region
agggagggagggagagg

SEQ ID NO: 41 - RNA, 19 nt, Unknown
  exogenous stem loop region
gguuaggguuaggguuagg

SEQ ID NO: 42 - RNA, 25 nt, Unknown
  exogenous stem loop region
cugcucaguacgagaggaaccgcag

SEQ ID NO: 43 - RNA, 78 nt, Unknown
  exogenous stem loop region
uacacugggaucgcugaauuagagaucggcguccuuucauucuauauacuuuggaguuuuaaaaugucucuaaguaca

SEQ ID NO: 44 - protein, 979 aa, Artificial Sequence
  catalytically dead CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 45 - protein, 979 aa, Artificial Sequence
  catalytically dead CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 46 - protein, 978 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 47 - protein, 979 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 48 - protein, 979 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 49 - protein, 978 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 50 - protein, 978 aa, Artificial Sequence
  catalytically dead CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 51 - protein, 978 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 52 - protein, 978 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 53 - protein, 977 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 54 - protein, 978 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 55 - protein, 979 aa, Artificial Sequence
  catalytically dead CasX variant
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 56 - protein, 978 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 57 - protein, 977 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTTQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 58 - protein, 977 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKRSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 59 - protein, 977 aa, Artificial Sequence
  catalytically dead CasX variant
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 60 - protein, 977 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 61 - protein, 977 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAATQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 62 - protein, 977 aa, Artificial Sequence
  catalytically dead CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAAKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 63 - protein, 11 aa, Artificial Sequence
  nuclear localization signal
PAKRARRGYKC

SEQ ID NO: 64 - protein, 11 aa, Artificial Sequence
  nuclear localization signal
KLGPRKATGRW

SEQ ID NO: 65 - protein, 7 aa, Artificial Sequence
  nuclear localization signal
PRRKREE

SEQ ID NO: 66 - protein, 7 aa, Artificial Sequence
  nuclear localization signal
PYRGRKE

SEQ ID NO: 67 - protein, 8 aa, Artificial Sequence
  nuclear localization signal
PLRKRPRR

SEQ ID NO: 68 - protein, 18 aa, Artificial Sequence
  nuclear localization signal
PLRKRPRRGSPLRKRPRR

SEQ ID NO: 69 - protein, 29 aa, Artificial Sequence
  nuclear localization signal
PAAKRVKLDGGKRTADGSEFESPKKKRKV

SEQ ID NO: 70 - protein, 37 aa, Artificial Sequence
  nuclear localization signal
PAAKRVKLDGGKRTADGSEFESPKKKRKVGIHGVPAA

SEQ ID NO: 71 - protein, 46 aa, Artificial Sequence
  nuclear localization signal
PAAKRVKLDGGKRTADGSEFESPKKKRKVAEAAAKEAAAKEAAAKA

SEQ ID NO: 72 - protein, 31 aa, Artificial Sequence
  nuclear localization signal
PAAKRVKLDGGKRTADGSEFESPKKKRKVPG

SEQ ID NO: 73 - protein, 15 aa, Artificial Sequence
  nuclear localization signal
KRKGSPERGERKRHW

SEQ ID NO: 74 - protein, 28 aa, Artificial Sequence
  nuclear localization signal
KRTADSQHSTPPKTKRKVEFEPKKKRKV

SEQ ID NO: 75 - protein, 38 aa, Artificial Sequence
  nuclear localization signal
PKKKRKVGGSKRTADSQHSTPPKTKRKVEFEPKKKRKV

SEQ ID NO: 76 - DNA, 2931 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 77 - DNA, 2931 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 78 - DNA, 2934 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 79 - DNA, 2934 bp, Artificial Sequence
  CasX variant
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 80 - DNA, 2934 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 81 - DNA, 2934 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctacccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 82 - DNA, 2934 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctgcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 83 - DNA, 2934 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 84 - DNA, 2931 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccaacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 85 - DNA, 2931 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttcagcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 86 - DNA, 2931 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaaaacgaccggaagaagggcaagaagttcgccagataccagttcggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttcagcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagaccctgctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 87 - DNA, 2931 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccaacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 88 - DNA, 2931 bp, Artificial Sequence
  CasX variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaacccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 89 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 90 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 91 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 92 - protein, 978 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 93 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 94 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 95 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 96 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 97 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 98 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 99 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 100 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 101 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 102 - DNA, 60 bp, Artificial Sequence; identical to SEQ ID NO: 28
  in vitro cleavage assay target

SEQ ID NO: 103 - DNA, 60 bp, Artificial Sequence
  in vitro cleavage assay target
agcgcgagcacagctaaggccacggagcgagacatctcggcccgaatgctgtcagcttca

SEQ ID NO: 104 - DNA, 60 bp, Artificial Sequence; identical to SEQ ID NO: 28
  in vitro cleavage assay target

SEQ ID NO: 105 - DNA, 60 bp, Artificial Sequence
  in vitro cleavage assay target
agcgcgagcacagctaaggccacggagcgagacatctcggcccgagtgctgtcagcttca

SEQ ID NO: 106 - DNA, 60 bp, Artificial Sequence
  in vitro cleavage assay target
tgaagctgacagcactcgggccgagatgtctcgctccgtggccttagctgtgctcgcgct

SEQ ID NO: 107 - DNA, 60 bp, Artificial Sequence
  in vitro cleavage assay target
agcgcgagcacagctaaggccacggagcgagacatctcggcccgactgctgtcagcttca

SEQ ID NO: 108 - DNA, 60 bp, Artificial Sequence
  in vitro cleavage assay target
tgaagctgacagcagtcgggccgagatgtctcgctccgtggccttagctgtgctcgcgct

SEQ ID NO: 109 - DNA, 60 bp, Artificial Sequence
  in vitro cleavage assay target
agcgcgagcacagctaaggccacggagcgagacatctcggcccgattgctgtcagcttca

SEQ ID NO: 110 - DNA, 60 bp, Artificial Sequence
  in vitro cleavage assay target
tgaagctgacagcaatcgggccgagatgtctcgctccgtggccttagctgtgctcgcgct

SEQ ID NO: 111 - DNA, 60 bp, Artificial Sequence; identical to SEQ ID NO: 103
  in vitro cleavage assay target

SEQ ID NO: 112 - DNA, 60 bp, Artificial Sequence; identical to SEQ ID NO: 28
  in vitro cleavage assay target

SEQ ID NO: 113 - DNA, 60 bp, Artificial Sequence; identical to SEQ ID NO: 105
  in vitro cleavage assay target

SEQ ID NO: 114 - DNA, 60 bp, Artificial Sequence; identical to SEQ ID NO: 106
  in vitro cleavage assay target

SEQ ID NO: 115 - DNA, 60 bp, Artificial Sequence; identical to SEQ ID NO: 107
  in vitro cleavage assay target

SEQ ID NO: 116 - DNA, 60 bp, Artificial Sequence; identical to SEQ ID NO: 108
  in vitro cleavage assay target

SEQ ID NO: 117 - DNA, 60 bp, Artificial Sequence; identical to SEQ ID NO: 109
  in vitro cleavage assay target

SEQ ID NO: 118 - DNA, 60 bp, Artificial Sequence; identical to SEQ ID NO: 110
  in vitro cleavage assay target

SEQ ID NO: 119 - DNA, 60 bp, Artificial Sequence
  in vitro cleavage assay target
agcgcgagcacagctaaggccacggagcgagacatctcggcccaaatgctgtcagcttca

SEQ ID NO: 120 - DNA, 60 bp, Artificial Sequence
  in vitro cleavage assay target
tgaagctgacagcatttgggccgagatgtctcgctccgtggccttagctgtgctcgcgct

SEQ ID NO: 121 - DNA, 60 bp, Artificial Sequence
  in vitro cleavage assay target
agcgcgagcacagctaaggccacggagcgagacatctcggccctagtgctgtcagcttca

SEQ ID NO: 122 - DNA, 60 bp, Artificial Sequence
  in vitro cleavage assay target
tgaagctgacagcacttgggccgagatgtctcgctccgtggccttagctgtgctcgcgct

SEQ ID NO: 123 - DNA, 60 bp, Artificial Sequence
  in vitro cleavage assay target
agcgcgagcacagctaaggccacggagcgagacatctcggccctactgctgtcagcttca

SEQ ID NO: 124 - DNA, 60 bp, Artificial Sequence
  in vitro cleavage assay target
tgaagctgacagcagttgggccgagatgtctcgctccgtggccttagctgtgctcgcgct

SEQ ID NO: 125 - DNA, 60 bp, Artificial Sequence
  in vitro cleavage assay target
agcgcgagcacagctaaggccacggagcgagacatctcggccctattgctgtcagcttca

SEQ ID NO: 126 - DNA, 60 bp, Artificial Sequence
  in vitro cleavage assay target
tgaagctgacagcaattgggccgagatgtctcgctccgtggccttagctgtgctcgcgct

SEQ ID NO: 127 - DNA, 89 bp, Artificial Sequence
  5' or 3' gNA extension
gggtcggcatggcatctccacctcctcgcggtccgacctgggcatccgaaggaggacgcacgtccactcggatggctaagggagagcca

SEQ ID NO: 128 - DNA, 86 bp, Artificial Sequence
  5' or 3' gNA extension
ggccggcatggtcccagcctcctcgctggcgccggctgggcaacattccgaggggaccgtcccctcggtaatggcgaatgggaccc

SEQ ID NO: 129 - DNA, 69 bp, Artificial Sequence
  5' or 3' gNA extension
gatggccggcatggtcccagcctcctcgctggcgccggctgggcaacaccttcgggtggcgaatgggac

SEQ ID NO: 130 - DNA, 78 bp, Artificial Sequence
  5' or 3' gNA extension
ttttggccggcatggtcccagcctcctcgctggcgccggctgggcaacatgcttcggcatggcgaatgggaccccggg

SEQ ID NO: 131 - DNA, 78 bp, Artificial Sequence
  5' or 3' gNA extension
cattcctcagaaaatgacaaacctgtggggcgtaagtagatcttcggatctatgatcgtgcagacgttaaaatcaggt

SEQ ID NO: 132 - DNA, 64 bp, Artificial Sequence
  5' or 3' gNA extension
cgtggttagggccacgttaaatagttgcttaagccctaagcgttgatcttcggatcaggtgcaa

SEQ ID NO: 133 - DNA, 60 bp, Artificial Sequence
  5' or 3' gNA extension
gggagccccgctgatgaggtcggggagaccgaaagggacttcggtccctacggggctccc

SEQ ID NO: 134 - DNA, 52 bp, Artificial Sequence
  5' or 3' gNA extension
cctgtcaccggatgtgctttccggtctgatgagtccgtgaggacgaaacagg

SEQ ID NO: 135 - DNA, 63 bp, Artificial Sequence
  5' or 3' gNA extension
cgactactgatgagtccgtgaggacgaaacgagtaagctcgtctagtcgcgtgtagcgaagca

SEQ ID NO: 136 - DNA, 49 bp, Artificial Sequence
  5' or 3' gNA extension
cgactactgatgagtccgtgaggacgaaacgagtaagctcgtctagtcg

SEQ ID NO: 137 - DNA, 63 bp, Artificial Sequence
  5' or 3' gNA extension
ccagtactgatgagtccgtgaggacgaaacgagtaagctcgtctactggcgcttttatctcat

SEQ ID NO: 138 - DNA, 77 bp, Artificial Sequence
  5' or 3' gNA extension
acccgcaaggccgacggcatccgccgccgctggtgcaagtccagccgccccttcgggggcgggcgctcatgggtaac

SEQ ID NO: 139 - DNA, 76 bp, Artificial Sequence
  5' or 3' gNA extension
ggcaataaagcggttacaagcccgcaaaaatagcagagtaatgtcgcgatagcgcggcattaatgcagctttattg

SEQ ID NO: 140 - DNA, 36 bp, Artificial Sequence
  5' or 3' gNA extension
ccacccccaccaccacccccacccccaccaccaccc

SEQ ID NO: 141 - DNA, 40 bp, Artificial Sequence
  PCR1 Fwd primer
  misc_feature (34)..(40): n is any nucleotide
acactctttccctacacgacgctcttccgatctnnnnnnn

SEQ ID NO: 142 - DNA, 34 bp, Artificial Sequence
  PCR2 Rvs primer
gtgactggagttcagacgtgtgctcttccgatct

SEQ ID NO: 143 - DNA, 52 bp, Artificial Sequence
  PCR2 Fwd primer
aatgatacggcgaccaccgagatctacactctttccctacacgacgctcttc

SEQ ID NO: 144 - DNA, 64 bp, Artificial Sequence
  PCR2 Rvs v1 001 primer
caagcagaagacggcatacgagatcgtgatgtgactggagttcagacgtgtgctcttccgatct

SEQ ID NO: 145 - DNA, 168 bp, Artificial Sequence
  Planctomyces reference guide scaffold from the plasmid backbone
tgacagctagctcagtcctaggtataatactagttactggcgcttttatctcattactttgagagccatcaccagcgactatgtcgtatgggtaaagcgcttatttatcggagagaaatccgataaataagaagcatcaaagctggagttgtcccaattcttctagag

SEQ ID NO: 146 - DNA, 82 bp, Artificial Sequence
  PCR primer SAH24
ttcaggttggaccggtgccaccatggccccaaagaagaagcggaaggtcagccaagagatcaagagaatcaacaagatcaga

SEQ ID NO: 147 - DNA, 28 bp, Artificial Sequence
  PCR primer SAH25
ttttggactagtcacggcgggcttccag

SEQ ID NO: 148 - DNA, 37 bp, Artificial Sequence
  PCR primer oIC539
atggccccaaagaagaagcggaaggtctctagacaag

SEQ ID NO: 149 - DNA, 32 bp, Artificial Sequence
  PCR primer oIC540
tacctttctcttcttttttggactagtcacgg

SEQ ID NO: 150 - RNA, 20 nt, Artificial Sequence
  spacer 4.76
uguggucgggguagcggcug

SEQ ID NO: 151 - RNA, 20 nt, Artificial Sequence
  spacer 4.77
ucaaguccgccaugcccgaa

SEQ ID NO: 152 - RNA, 20 nt, Artificial Sequence
  spacer 8.2
auguucaugaguuuggagau

SEQ ID NO: 153 - RNA, 20 nt, Artificial Sequence
  spacer 8.4
ucgccauaacucgcuaggcc

SEQ ID NO: 154 - DNA, 20 bp, Artificial Sequence
  spacer 23.11
tccccgatatgcaccaccgg

SEQ ID NO: 155 - DNA, 20 bp, Artificial Sequence
  spacer 23.2
agagcgtgatattaccctgt

SEQ ID NO: 156 - DNA, 20 bp, Artificial Sequence
  spacer 23.1
cgctctagaatgcgacgggt

SEQ ID NO: 157 - DNA, 20 bp, Artificial Sequence
  spacer 23.19
ccgatatgcaccaccgggta

SEQ ID NO: 158 - RNA, 19 nt, Artificial Sequence
  triplex loop
cuuuaucucauuacuuuga

SEQ ID NO: 159 - DNA, 31 bp, Artificial Sequence
  stem loop sequence
aaaacgcuuuaucucauuacuuugacgtttt

SEQ ID NO: 160 - RNA, 19 nt, Artificial Sequence
  constraint string on stem-loop
  misc_feature (1)..(19): n is any nucleotide
nnnnnnnnnnnnnnnnnnn

SEQ ID NO: 161 - DNA, 20 bp, Artificial Sequence
  23.2 spacer
agagcgtgatattaccctgt

SEQ ID NO: 162 - DNA, 20 bp, Artificial Sequence
  23.13 spacer
ccctttgacgttggagtcca

SEQ ID NO: 163 - DNA, 20 bp, Artificial Sequence
  11.2 spacer
aagtggctgcgtaccacacc

SEQ ID NO: 164 - DNA, 20 bp, Artificial Sequence
  23.27 spacer
gtacatccacaaacagacga

SEQ ID NO: 165 - DNA, 20 bp, Artificial Sequence
  15.3 spacer
caaacaaatgtgtcacaaag

SEQ ID NO: 166 - DNA, 20 bp, Artificial Sequence
  15.5 spacer
ggaataatgctgttgttgaa

SEQ ID NO: 167 - DNA, 87 bp, Artificial Sequence
  Scaffold 174 template fwd primer
gaaattaatacgactcactataactggcgcttttatctgattactttgagagccatcaccagcgactatgtcgtagtgggtaaagct

SEQ ID NO: 168 - DNA, 50 bp, Artificial Sequence
  Scaffold 174 template rev primer
ctttgatgctccctccgaagagggagctttacccactacgacatagtcgc

SEQ ID NO: 169 - DNA, 22 bp, Artificial Sequence
  T7 amplification primer
gaaattaatacgactcactata

SEQ ID NO: 170 - DNA, 36 bp, Artificial Sequence
  15.3 20-nt spacer primer
ctttgtgacacatttgtttgctttgatgctccctcc

SEQ ID NO: 171 - DNA, 35 bp, Artificial Sequence
  15.3 19-nt spacer primer
tttgtgacacatttgtttgctttgatgctccctcc

SEQ ID NO: 172 - DNA, 34 bp, Artificial Sequence
  15.3 18-nt spacer primer
ttgtgacacatttgtttgctttgatgctccctcc

SEQ ID NO: 173 - DNA, 36 bp, Artificial Sequence
  15.5 20-nt spacer primer
ttcaacaacagcattattccctttgatgctccctcc

SEQ ID NO: 174 - DNA, 35 bp, Artificial Sequence
  15.5 19-nt spacer primer
tcaacaacagcattattccctttgatgctccctcc

SEQ ID NO: 175 - DNA, 34 bp, Artificial Sequence
  15.5 18-nt spacer primer
caacaacagcattattccctttgatgctccctcc

SEQ ID NO: 176 - RNA, 20 nt, Artificial Sequence
  15.3 20-nt spacer
caaacaaaugugucacaaag

SEQ ID NO: 177 - RNA, 19 nt, Artificial Sequence
  15.3 19-nt spacer
caaacaaaugugucacaaa

SEQ ID NO: 178 - RNA, 18 nt, Artificial Sequence
  15.3 18-nt spacer
caaacaaaugugucacaa

SEQ ID NO: 179 - RNA, 20 nt, Artificial Sequence
  15.5 20-nt spacer
ggaauaaugcuguuguugaa

SEQ ID NO: 180 - RNA, 19 nt, Artificial Sequence
  15.5 19-nt spacer
ggaauaaugcuguuguuga

SEQ ID NO: 181 - RNA, 18 nt, Artificial Sequence
  15.5 18-nt spacer
ggaauaaugcuguuguug

SEQ ID NO: 182 - DNA, 20 bp, Artificial Sequence
  7.37 spacer
ggccgagatgtctcgctccg

SEQ ID NO: 183 - DNA, 60 bp, Artificial Sequence; identical to SEQ ID NO: 28
  7.37 target sequence non-target strand

SEQ ID NO: 184 - DNA, 60 bp, Artificial Sequence; identical to SEQ ID NO: 103
  7.37 target sequence target strand

SEQ ID NO: 185 - DNA, 20 bp, Artificial Sequence
  20-nt spacer sequence
ggccgagatgtctcgctccg

SEQ ID NO: 186 - DNA, 18 bp, Artificial Sequence
  18-nt spacer sequence
ggccgagatgtctcgctc

SEQ ID NO: 187 - DNA, 19 bp, Artificial Sequence
  19-nt spacer sequence
ggccgagatgtctcgctcc

SEQ ID NO: 188 - DNA, 87 bp, Artificial Sequence; identical to SEQ ID NO: 167
  Scaffold 174 template fwd

SEQ ID NO: 189 - DNA, 50 bp, Artificial Sequence; identical to SEQ ID NO: 168
  Scaffold 174 template rev

SEQ ID NO: 190 - DNA, 22 bp, Artificial Sequence
  T7 amplification primer
gaaattaatacgactcactata

SEQ ID NO: 191 - DNA, 36 bp, Artificial Sequence
  Scaffold 174 20-nt spacer primer
cggagcgagacatctcggccctttgatgctccctcc

SEQ ID NO: 192 - DNA, 34 bp, Artificial Sequence
  Scaffold 174 18-nt spacer primer
gagcgagacatctcggccctttgatgctccctcc

SEQ ID NO: 193 - DNA, 35 bp, Artificial Sequence
  Scaffold 174 19-nt spacer primer
ggagcgagacatctcggccctttgatgctccctcc

SEQ ID NO: 194 - DNA, 20 bp, Artificial Sequence
  spacer sequence
ctgcattctagttgtggttt

SEQ ID NO: 195 - DNA, 19 bp, Artificial Sequence
  spacer sequence
ctgcattctagttgtggtt

SEQ ID NO: 196 - DNA, 19 bp, Artificial Sequence
  spacer sequence
ctgcattctagttgtggtt

SEQ ID NO: 197 - DNA, 19 bp, Artificial Sequence
  spacer sequence
ctgcattctagttgtggtt

SEQ ID NO: 198 - DNA, 19 bp, Artificial Sequence
  spacer sequence
ctgcattctagttgtggtt

SEQ ID NO: 199 - DNA, 19 bp, Artificial Sequence
  spacer sequence
ctgcattctagttgtggtt

SEQ ID NO: 200 - DNA, 19 bp, Artificial Sequence
  spacer sequence
ctgcattctagttgtggtt

SEQ ID NO: 201 - DNA, 19 bp, Artificial Sequence
  spacer sequence
ctgcattctagttgtggtt

SEQ ID NO: 202 - DNA, 19 bp, Artificial Sequence
  spacer sequence
ctgcattctagttgtggtt

SEQ ID NO: 203 - DNA, 19 bp, Artificial Sequence
  spacer sequence
ctgcattctagttgtggtt

SEQ ID NO: 204 - DNA, 20 bp, Artificial Sequence
  spacer sequence
aaggggctccgcaccacgcc

SEQ ID NO: 205 - DNA, 20 bp, Artificial Sequence
  spacer sequence
aaggggctccgcaccacgcc

SEQ ID NO: 206 - DNA, 20 bp, Artificial Sequence
  spacer sequence
aaggggctccgcaccacgcc

SEQ ID NO: 207 - DNA, 20 bp, Artificial Sequence
  spacer sequence
aaggggctccgcaccacgcc

SEQ ID NO: 208 - DNA, 20 bp, Artificial Sequence
  spacer sequence
aaggggctccgcaccacgcc

SEQ ID NO: 209 - DNA, 20 bp, Artificial Sequence
  spacer sequence
aaggggctccgcaccacgcc

SEQ ID NO: 210 - DNA, 20 bp, Artificial Sequence
  spacer sequence
aaggggctccgcaccacgcc

SEQ ID NO: 211 - DNA, 20 bp, Artificial Sequence
  spacer sequence
aaggggctccgcaccacgcc

SEQ ID NO: 212 - DNA, 20 bp, Artificial Sequence
  spacer sequence
aaggggctccgcaccacgcc

SEQ ID NO: 213 - DNA, 20 bp, Artificial Sequence
  spacer sequence
aaggggctccgcaccacgcc

SEQ ID NO: 214 - DNA, 20 bp, Artificial Sequence
  spacer sequence
aaggggctccgcaccacgcc

SEQ ID NO: 215 - DNA, 20 bp, Artificial Sequence
  spacer sequence
aagtggctccgcaccacgcc

SEQ ID NO: 216 - DNA, 20 bp, Artificial Sequence
  spacer sequence
aaggggctgcgtaccacacc

SEQ ID NO: 217 - DNA, 20 bp, Artificial Sequence
  spacer sequence
aaggggctgcgtaccacacc

SEQ ID NO: 218 - DNA, 18 bp, Artificial Sequence
  spacer sequence
gggtcttcgagaagaccc

SEQ ID NO: 219 - protein, 46 aa, Artificial Sequence
  nuclear localization signal
PKKKRKVGGSPKKKRKVSRQEIKRINKIRRRLVKDSNTKKAGKTGP

SEQ ID NO: 220 - protein, 66 aa, Artificial Sequence
  nuclear localization signal
PKKKRKVGGSPKKKRKVGGSPKKKRKVGGSPKKKRKVSRQEIKRINKIRRRLVKDSNTKKAGKTGP

SEQ ID NO: 221 - protein, 86 aa, Artificial Sequence
  nuclear localization signal
PKKKRKVGGSPKKKRKVGGSPKKKRKVGGSPKKKRKVGGSPKKKRKVGGSPKKKRKVSRQEIKRINKIRRRLVKDSNTKKAGKTGP

SEQ ID NO: 222 - protein, 50 aa, Artificial Sequence
  nuclear localization signal
PAAKRVKLDGGSPAAKRVKLDSRQEIKRINKIRRRLVKDSNTKKAGKTGP

SEQ ID NO: 223 - protein, 74 aa, Artificial Sequence
  nuclear localization signal
PAAKRVKLDGGSPAAKRVKLDGGSPAAKRVKLDGGSPAAKRVKLDSRQEIKRINKIRRRLVKDSNTKKAGKTGP

SEQ ID NO: 224 - protein, 98 aa, Artificial Sequence
  nuclear localization signal
PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGP

SEQ ID NO: 225 - protein, 49 aa, Artificial Sequence
  nuclear localization signal
KRPAATKKAGQAKKKKSRDISRQEIKRINKIRRRLVKDSNTKKAGKTGP

SEQ ID NO: 226 - protein, 45 aa, Artificial Sequence
  nuclear localization signal
KRPAATKKAGQAKKKKSRQEIKRINKIRRRLVKDSNTKKAGKTGP

SEQ ID NO: 227 - protein, 68 aa, Artificial Sequence
  nuclear localization signal
KRPAATKKAGQAKKKKGGSKRPAATKKAGQAKKKKSRDISRQEIKRINKIRRRLVKDSNTKKAGKTGP

SEQ ID NO: 228 - protein, 106 aa, Artificial Sequence
  nuclear localization signal
KRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP

SEQ ID NO: 229 - protein, 144 aa, Artificial Sequence
  nuclear localization signal
KRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP

SEQ ID NO: 230 - protein, 70 aa, Artificial Sequence
  nuclear localization signal
PKKKRKVGGSPKKKRKVGGSPKKKRKVGGSPKKKRKVSRDISRQEIKRINKIRRRLVKDSNTKKAGKTGP

SEQ ID NO: 231 - protein, 78 aa, Artificial Sequence
  nuclear localization signal
PAAKRVKLDGGSPAAKRVKLDGGSPAAKRVKLDGGSPAAKRVKLDSRDISRQEIKRINKIRRRLVKDSNTKKAGKTGP

SEQ ID NO: 232 - protein, 102 aa, Artificial Sequence
  nuclear localization signal
PAAKRVKLDGGSPAAKRVKLDGGSPAAKRVKLDGGSPAAKRVKLDGGSPAAKRVKLDGGSPAAKRVKLDSRDISRQEIKRINKIRRRLVKDSNTKKAGKTGP

SEQ ID NO: 233 - protein, 65 aa, Artificial Sequence
  nuclear localization signal
PAAKRVKLDGGKRTADGSEFESPKKKRKVGGSSRDISRQEIKRINKIRRRLVKDSNTKKAGKTGP

SEQ ID NO: 234 - protein, 67 aa, Artificial Sequence
  nuclear localization signal
PAAKRVKLDGGKRTADGSEFESPKKKRKVPPPPGSRDISRQEIKRINKIRRRLVKDSNTKKAGKTGP

SEQ ID NO: 235 - protein, 72 aa, Artificial Sequence
  nuclear localization signal
PAAKRVKLDGGKRTADGSEFESPKKKRKVGIHGVPAAPGSRDISRQEIKRINKIRRRLVKDSNTKKAGKTGP

SEQ ID NO: 236 - protein, 72 aa, Artificial Sequence
  nuclear localization signal
PAAKRVKLDGGKRTADGSEFESPKKKRKVGGGSGGGSPGSRDISRQEIKRINKIRRRLVKDSNTKKAGKTGP

SEQ ID NO: 237 - RNA, 26 nt, Unknown
  scaffold stem loop of an exemplary reference sgRNA
ccaucaccagcgacuaugucguaugg

SEQ ID NO: 238 - RNA, 46 nt, Unknown
  extended stem loop sequence of an exemplary reference sgRNA
guaaacgcuuauuuaucggagagaaauccgauaaauaagaagcauc

SEQ ID NO: 239 - protein, 73 aa, Artificial Sequence
  nuclear localization signal
PAAKRVKLDGGKRTADGSEFESPKKKRKVPGGGSGGGSPGSRDISRQEIKRINKIRRRLVKDSNTKKAGKTGP

SEQ ID NO: 240 - RNA, 31 nt, Artificial Sequence
  stem loop sequence
  misc_feature (4)..(28): n is any ribonucleotide
  misc_feature (8)..(28): individual nucleotides may be absent
uuunnnnnnnnnnnnnnnnnnnnnnnnnuuu

SEQ ID NO: 241 - RNA, 21 nt, Artificial Sequence
  stem loop sequence
  misc_feature (4)..(18): n is any ribonucleotide
  misc_feature (8)..(18): individual nucleotides may be absent
uuunnnnnnnnnnnnnnnuuu

SEQ ID NO: 242 - RNA, 20 nt, Artificial Sequence
  scaffold stem loop sequence of a gNA
ccagcgacuaugucguaugg

SEQ ID NO: 243 - RNA, 23 nt, Unknown
  crRNA sequence
ccgauaaguaaaacgcaucaaag

SEQ ID NO: 244 - RNA, 26 nt, Unknown
  crRNA sequence
ucuccgauaaauaagaagcaucaaag

SEQ ID NO: 245 - RNA, 21 nt, Unknown
  scaffold stem loop
ccagcgacuaugucguagugg

SEQ ID NO: 246 - protein, 4 aa, Artificial Sequence
  zinc/finger/ribbon motif
  misc_feature (2)..(3): Xaa is any amino acid
CXXC

SEQ ID NO: 247 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 248 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLRSQEYKKYQTNKTTGNTDKRAFVETWQSFYRKKLKEVWKPAV

SEQ ID NO: 249 - protein, 985 aa, Artificial Sequence
  CasX variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 250 - protein, 986 aa, Artificial Sequence
  CasX variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 251 - protein, 921 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 252 - protein, 920 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 253 - protein, 977 aa, Artificial Sequence
  CasX variant
MQEIKRINKIRRRLVKDSNTKKAGKTGPMKTLLVRVMTPDLRERLENLRKKPENIPQPISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 254 - protein, 986 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 255 - protein, 925 aa, Artificial Sequence
  CasX variant
MISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 256 - protein, 975 aa, Artificial Sequence
  CasX variant
MEKRINKIRKKLSADNATKPVSRSGPMKTLLVRVMTDDLKKRLEKRRKKPEVMPQVISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 257 - protein, 982 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 258 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 259 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPA

SEQ ID NO: 260 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 261 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDQLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 262 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFQAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 263 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLIAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 264 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 265 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 266 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 267 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 268 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEKEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 269 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 270 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 271 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 272 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 273 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 274 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGDPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 275 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEFLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 276 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 277 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 278 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 279 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIIIEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFNAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 280 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAKTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 281 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 282 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIMENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 283 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 284 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 285 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 286 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 287 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQVRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 288 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 289 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 290 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 291 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 292 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 293 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 294 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 295 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 296 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 297 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 298 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 299 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 300 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 301 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 302 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 303 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 304 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 305 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 306 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 307 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 308 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 309 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 310 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 311 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 312 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 313 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 314 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 315 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 316 - protein, 977 aa, Artificial Sequence; identical to SEQ ID NO: 270
  CasX variant

SEQ ID NO: 317 - protein, 977 aa, Artificial Sequence; identical to SEQ ID NO: 270
  CasX variant

SEQ ID NO: 318 - protein, 977 aa, Artificial Sequence; identical to SEQ ID NO: 270
  CasX variant

SEQ ID NO: 319 - protein, 977 aa, Artificial Sequence; identical to SEQ ID NO: 270
  CasX variant

SEQ ID NO: 320 - protein, 977 aa, Artificial Sequence; identical to SEQ ID NO: 270
  CasX variant

SEQ ID NO: 321 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 322 - protein, 977 aa, Artificial Sequence; identical to SEQ ID NO: 270
  CasX variant

SEQ ID NO: 323 - protein, 977 aa, Artificial Sequence; identical to SEQ ID NO: 270
  CasX variant

SEQ ID NO: 324 - protein, 977 aa, Artificial Sequence; identical to SEQ ID NO: 270
  CasX variant

SEQ ID NO: 325 - protein, 977 aa, Artificial Sequence; identical to SEQ ID NO: 270
  CasX variant

SEQ ID NO: 326 - protein, 977 aa, Artificial Sequence; identical to SEQ ID NO: 270
  CasX variant

SEQ ID NO: 327 - protein, 977 aa, Artificial Sequence; identical to SEQ ID NO: 270
  CasX variant

SEQ ID NO: 328 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 329 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 330 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 331 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 332 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 333 - protein, 977 aa, Artificial Sequence; identical to SEQ ID NO: 89
  CasX variant

SEQ ID NO: 334 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 335 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 336 - protein, 977 aa, Artificial Sequence; identical to SEQ ID NO: 90
  CasX variant

SEQ ID NO: 337 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 338 - protein, 84 aa, Unknown
  chloroplast transit peptide
MASMISSSAVTTVSRASRGQSAAMAPFGGLKSMTGFPVRKVNTDITSITSNGGRVKCMQVWPPIGKKKFETLSYLPPLTRDSRA

SEQ ID NO: 339 - protein, 57 aa, Unknown
  chloroplast transit peptide
MASMISSSAVTTVSRASRGQSAAMAPFGGLKSMTGFPVRKVNTDITSITSNGGRVKS

SEQ ID NO: 340 - protein, 85 aa, Unknown
  chloroplast transit peptide
MASSMLSSATMVASPAQATMVAPFNGLKSSAAFPATRKANNDITSITSNGGRVNCMQVWPPIEKKKFETLSYLPDLTDSGGRVNC

SEQ ID NO: 341 - protein, 76 aa, Unknown
  chloroplast transit peptide
MAQVSRICNGVQNPSLISNLSKSSQRKSPLSVSLKTQQHPRAYPISSSWGLKKSGMTLIGSELRPLKVMSSVSTAC

SEQ ID NO: 342 - protein, 76 aa, Unknown
  chloroplast transit peptide
MAQVSRICNGVWNPSLISNLSKSSQRKSPLSVSLKTQQHPRAYPISSSWGLKKSGMTLIGSELRPLKVMSSVSTAC

SEQ ID NO: 343 - protein, 72 aa, Unknown
  chloroplast transit peptide
MAQINNMAQGIQTLNPNSNFHKPQVPKSSSFLVFGSKKLKNSANSMLVLKKDSIFMQLFCSFRISASVATAC

SEQ ID NO: 344 - protein, 69 aa, Unknown
  chloroplast transit peptide
MAALVTSQLATSGTVLSVTDRFRRPGFQGLRPRNPADAALGMRTVGASAAPKQSRKPHRFDRRCLSMVV

SEQ ID NO: 345 - protein, 77 aa, Unknown
  chloroplast transit peptide
MAALTTSQLATSATGFGIADRSAPSSLLRHGFQGLKPRSPAGGDATSLSVTTSARATPKQQRSVQRGSRRFPSVVVC

SEQ ID NO: 346 - protein, 57 aa, Unknown
  chloroplast transit peptide
MASSVLSSAAVATRSNVAQANMVAPFTGLKSAASFPVSRKQNLDITSIASNGGRVQC

SEQ ID NO: 347 - protein, 65 aa, Unknown
  chloroplast transit peptide
MESLAATSVFAPSRVAVPAARALVRAGTVVPTRRTSSTSGTSGVKCSAAVTPQASPVISRSAAAA

SEQ ID NO: 348 - protein, 72 aa, Unknown
  chloroplast transit peptide
MGAAATSMQSLKFSNRLVPPSRRLSPVPNNVTCNNLPKSAAPVRTVKCCASSWNSTINGAAATTNGASAASS

SEQ ID NO: 349 - protein, 20 aa, Unknown
  endosomal escape peptide
  SITE (4)..(4): Xaa is Lys, His or Arg
  SITE (8)..(8): Xaa is Lys, His or Arg
  SITE (11)..(11): Xaa is Lys, His or Arg
  SITE (15)..(15): Xaa is Lys, His or Arg
  SITE (19)..(19): Xaa is Lys, His or Arg
GLFXALLXLLXSLWXLLLXA

SEQ ID NO: 350 - protein, 20 aa, Unknown
  endosomal escape peptide
GLFHALLHLLHSLWHLLLHA

SEQ ID NO: 351 - protein, 9 aa, Unknown
  endosomal escape peptide
HHHHHHHHH

SEQ ID NO: 352 - protein, 7 aa, Betapolyomavirus macaca mulatta polyomavirus 1
PKKKRKV

SEQ ID NO: 353 - protein, 16 aa, Unknown
  nuclear localization signal
KRPAATKKAGQAKKKK

SEQ ID NO: 354 - protein, 9 aa, Homo sapiens
PAAKRVKLD

SEQ ID NO: 355 - protein, 11 aa, Homo sapiens
RQRRNELKRSP

SEQ ID NO: 356 - protein, 38 aa, Unknown
  nuclear localization signal
NQSSNFGPMKGGNFGGRSSGPYGGGGQYFAKPRNQGGY

SEQ ID NO: 357 - protein, 42 aa, Unknown
  nuclear localization signal
RMRIZFKNKGKDTAELRRRRVEVSVELRKAKKDEQILKRRNV

SEQ ID NO: 358 - protein, 8 aa, Unknown
  nuclear localization signal
VSRKRPRP

SEQ ID NO: 359 - protein, 8 aa, Unknown
  nuclear localization signal
PPKKARED

SEQ ID NO: 360 - protein, 8 aa, Homo sapiens
PQPKKKPL

SEQ ID NO: 361 - protein, 12 aa, Mus musculus
SALIKKKKKMAP

SEQ ID NO: 362 - protein, 5 aa, Alphainfluenzavirus influenza A virus
DRLRR

SEQ ID NO: 363 - protein, 7 aa, Alphainfluenzavirus influenza A virus
PKQKKRK

SEQ ID NO: 364 - protein, 10 aa, Deltavirus  hepatitis delta virus
RKLKKKIKKL

SEQ ID NO: 365 - protein, 10 aa, Mus musculus
REKKKFLKRR

SEQ ID NO: 366 - protein, 20 aa, Homo sapiens
KRKGDEVDGVDEVAKKKSKK

SEQ ID NO: 367 - protein, 17 aa, Homo sapiens
RKCLQAGMNLEARKTKK

SEQ ID NO: 368 - protein, 8 aa, Orthobornavirus mammalian 1 orthobornavirus
PRPRKIPR

SEQ ID NO: 369 - protein, 9 aa, Hepacivirus  hepacivirus C
PPRKKRTVV

SEQ ID NO: 370 - protein, 12 aa, Unknown
  nuclear localization signal
NLSKKKKRKREK

SEQ ID NO: 371 - protein, 10 aa, Unknown
  nuclear localization signal
RRPSRPFRKP

SEQ ID NO: 372 - protein, 8 aa, Lymphocryptovirus human gammaherpesvirus 4
KRPRSPSS

SEQ ID NO: 373 - protein, 19 aa, Alphainfluenzavirus influenza A virus
KRGINDRNFWRGENERKTR

SEQ ID NO: 374 - protein, 11 aa, Homo sapiens
PRPPKMARYDN

SEQ ID NO: 375 - protein, 8 aa, Unknown
  nuclear localization signal
KRSFSKAF

SEQ ID NO: 376 - protein, 9 aa, Unknown
  nuclear localization signal
KLKIKRPVK

SEQ ID NO: 377 - protein, 19 aa, Unknown
  nuclear localization signal
PKKKRKVPPPPAAKRVKLD

SEQ ID NO: 378 - protein, 17 aa, Deltaretrovirus human T-lymphotropic virus 1
PKTRRRPRRSQRKRPPT

SEQ ID NO: 379 - protein, 24 aa, Caenorhabditis elegans
SRRRKANPTKLSENAKKLAKEVEN

SEQ ID NO: 380 - protein, 16 aa, Unknown
  nuclear localization signal
KTRRRPRRSQRKRPPT

SEQ ID NO: 381 - protein, 13 aa, Unknown
  nuclear localization signal
RRKKRRPRRKKRR

SEQ ID NO: 382 - protein, 14 aa, Unknown
  nuclear localization signal
PKKKSRKPKKKSRK

SEQ ID NO: 383 - protein, 17 aa, Unknown
  nuclear localization signal
HKKKHPDASVNFSEFSK

SEQ ID NO: 384 - protein, 18 aa, Unknown
  nuclear localization signal
QRPGPYDRPQRPGPYDRP

SEQ ID NO: 385 - protein, 16 aa, Unknown
  nuclear localization signal
LSPSLSPLLSPSLSPL

SEQ ID NO: 386 - protein, 18 aa, Unknown
  nuclear localization signal
RGKGGKGLGKGGAKRHRK

SEQ ID NO: 387 - protein, 14 aa, Unknown
  nuclear localization signal
PKRGRGRPKRGRGR

SEQ ID NO: 388 - protein, 19 aa, Unknown
  nuclear localization signal
PKKKRKVPPPPAAKRVKLD

SEQ ID NO: 389 - protein, 17 aa, Unknown
  nuclear localization signal
PKKKRKVPPPPKKKRKV

SEQ ID NO: 390 - protein, 11 aa, Lentivirus human immunodeficiency virus
YGRKKRRQRRR

SEQ ID NO: 391 - protein, 8 aa, Lentivirus human immunodeficiency virus
RKKRRQRR

SEQ ID NO: 392 - protein, 11 aa, Lentivirus human immunodeficiency virus
YARAAARQARA

SEQ ID NO: 393 - protein, 11 aa, Lentivirus human immunodeficiency virus
THRLPRRRRRR

SEQ ID NO: 394 - protein, 11 aa, Lentivirus human immunodeficiency virus
GGRRARRRRRR

SEQ ID NO: 395 - protein, 12 aa, Unknown
  peptide transduction domain
RRQRRTSKLMKR

SEQ ID NO: 396 - protein, 27 aa, Unknown
  peptide transduction domain
GWTLNSAGYLLGKINLKALAALAKKIL

SEQ ID NO: 397 - protein, 33 aa, Unknown
  peptide transduction domain
KALAWEAKLAKALAKALAKHLAKALAKALKCEA

SEQ ID NO: 398 - protein, 16 aa, Drosophila melanogaster
RQIKIWFQNRRMKWKK

SEQ ID NO: 399 - protein, 25 aa, Artificial Sequence
  linker polypeptide
  SITE (6)..(10): grouped amino acid residues may be present or absent
  SITE (11)..(15): grouped amino acid residues may be present or absent
  SITE (16)..(20): grouped amino acid residues may be present or absent
  SITE (21)..(25): grouped amino acid residues may be present or absent
GSGGSGSGGSGSGGSGSGGSGSGGS

SEQ ID NO: 400 - protein, 30 aa, Artificial Sequence
  linker polypeptide
  SITE (7)..(12): grouped amino acid residues may be present or absent
  SITE (13)..(18): grouped amino acid residues may be present or absent
  SITE (19)..(24): grouped amino acid residues may be present or absent
  SITE (25)..(30): grouped amino acid residues may be present or absent
GGSGGSGGSGGSGGSGGSGGSGGSGGSGGS

SEQ ID NO: 401 - protein, 20 aa, Artificial Sequence
  linker polypeptide
  SITE (5)..(8): grouped amino acid residues may be present or absent
  SITE (9)..(12): grouped amino acid residues may be present or absent
  SITE (13)..(16): grouped amino acid residues may be present or absent
  SITE (17)..(20): grouped amino acid residues may be present or absent
GGGSGGGSGGGSGGGSGGGS

SEQ ID NO: 402 - protein, 4 aa, Artificial Sequence
  linker polypeptide
GGSG

SEQ ID NO: 403 - protein, 5 aa, Artificial Sequence
  linker polypeptide
GGSGG

SEQ ID NO: 404 - protein, 5 aa, Artificial Sequence
  linker polypeptide
GSGSG

SEQ ID NO: 405 - protein, 5 aa, Artificial Sequence
  linker polypeptide
GSGGG

SEQ ID NO: 406 - protein, 5 aa, Artificial Sequence
  linker polypeptide
GGGSG

SEQ ID NO: 407 - protein, 5 aa, Artificial Sequence
  linker polypeptide
GSSSG

SEQ ID NO: 408 - protein, 4 aa, Artificial Sequence
  linker polypeptide
GPGP

SEQ ID NO: 409 - protein, 6 aa, Artificial Sequence
  linker polypeptide
PPAPPA

SEQ ID NO: 410 - protein, 7 aa, Artificial Sequence
  linker polypeptide
PPPGPPP

SEQ ID NO: 411 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLGVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 412 - protein, 986 aa, Artificial Sequence; identical to SEQ ID NO: 254
  CasX variant

SEQ ID NO: 413 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 414 - protein, 972 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 415 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 416 - protein, 978 aa, Artificial Sequence; identical to SEQ ID NO: 91
  CasX variant

SEQ ID NO: 417 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 418 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 419 - protein, 979 aa, Artificial Sequence
  CasX variant
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 420 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 421 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTTQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 422 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKRSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 423 - protein, 977 aa, Artificial Sequence
  CasX variant
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 424 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 425 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAATQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 426 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 427 - protein, 978 aa, Artificial Sequence; identical to SEQ ID NO: 92
  CasX variant

SEQ ID NO: 428 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 429 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 430 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 431 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 432 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 433 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 434 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 435 - protein, 978 aa, Artificial Sequence; identical to SEQ ID NO: 93
  CasX variant

SEQ ID NO: 436 - protein, 978 aa, Artificial Sequence; identical to SEQ ID NO: 94
  CasX variant

SEQ ID NO: 437 - protein, 978 aa, Artificial Sequence; identical to SEQ ID NO: 95
  CasX variant

SEQ ID NO: 438 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASVPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 439 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSLACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 440 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSNACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 441 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSQACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 442 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSSACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 443 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSAACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 444 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 445 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSTACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 446 - protein, 978 aa, Artificial Sequence
  CasX variant
QEIKRINKIRRRLVKDSNTKKAGKRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 447 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLHDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 448 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKEGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 449 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNINLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 450 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLFSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 451 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKWLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 452 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNDNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 453 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSTQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 454 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 455 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIPLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 456 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKKAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 457 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLKYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 458 - protein, 978 aa, Artificial Sequence
  CasX variant
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 459 - protein, 978 aa, Artificial Sequence
  CasX variant
QEEKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 460 - protein, 979 aa, Artificial Sequence
  CasX variant
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 461 - protein, 978 aa, Artificial Sequence
  CasX variant
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 462 - protein, 978 aa, Artificial Sequence
  CasX variant
QEISRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 463 - protein, 979 aa, Artificial Sequence
  CasX variant
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 464 - protein, 978 aa, Artificial Sequence
  CasX variant
QEIKSINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 465 - protein, 978 aa, Artificial Sequence
  CasX variant
QEIKRANKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 466 - protein, 979 aa, Artificial Sequence
  CasX variant
QEIKRGINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 467 - protein, 978 aa, Artificial Sequence
  CasX variant
QEIKRISKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 468 - protein, 978 aa, Artificial Sequence
  CasX variant
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 469 - protein, 979 aa, Artificial Sequence
  CasX variant
QEIKRINKIRRRLVKFDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 470 - protein, 979 aa, Artificial Sequence
  CasX variant
QEIKRINKIRRRLVKDSFNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 471 - protein, 978 aa, Artificial Sequence
  CasX variant
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 472 - protein, 978 aa, Artificial Sequence
  CasX variant
QEIKRINKIRRRLVKDSNTKKAGKTGPMKTLLVRVMTPDLRERLENLRKKPPNIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 473 - protein, 979 aa, Artificial Sequence
  CasX variant
QEIKRINKIRRRLVKDSNTKKAGKTGPMKTLLVRVMTPDLRERLENLRKKPENIPPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 474 - protein, 978 aa, Artificial Sequence
  CasX variant
QEIKRINKIRRRLVKDSNTKKAGKTGPMKTLLVRVMTPDLRERLENLRKKPENIPPPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 475 - protein, 978 aa, Artificial Sequence
  CasX variant
QEIKRINKIRRRLVKDSNTKKAGKTGPMKTLLVRVMTPDLRERLENLRKKPENIPQPISNTSSANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 476 - protein, 978 aa, Artificial Sequence
  CasX variant
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 477 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAITHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 478 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYGEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 479 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYDEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 480 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYAEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 481 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYREEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 482 - protein, 978 aa, Artificial Sequence; identical to SEQ ID NO: 96
  CasX variant

SEQ ID NO: 483 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 484 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 485 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPPKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 486 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 487 - protein, 978 aa, Artificial Sequence; identical to SEQ ID NO: 93
  CasX variant

SEQ ID NO: 488 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTGEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 489 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTSEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 490 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGLDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 491 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 492 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 493 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKNFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 494 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPQFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 495 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPALVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 496 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 497 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVPRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 498 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 499 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVLRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 500 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVRRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 501 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 502 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANHEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 503 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANAEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 504 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 505 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWPDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 506 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 507 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLMDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 508 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLNHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 509 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLWHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 510 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLYKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 511 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHPEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 512 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHEGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 513 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGERDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 514 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEWDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 515 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEYDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 516 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDYWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 517 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDRGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 518 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGDVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 519 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGPVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 520 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKLYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 521 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYGEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 522 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHQKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 523 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEEDRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 524 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAATTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 525 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKTSFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 526 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKKSFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 527 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVEEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 528 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVISEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 529 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIERGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 530 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGKKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 531 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGSKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 532 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADDKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 533 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDQEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 534 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEKCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 535 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRDELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 536 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCVELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 537 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 538 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCERKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 539 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKHQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 540 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQPWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 541 - protein, 978 aa, Artificial Sequence; identical to SEQ ID NO: 453
  CasX variant

SEQ ID NO: 542 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRFGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 543 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRVGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 544 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 545 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKTPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 546 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKNPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 547 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPRMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 548 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMSNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 549 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIWESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 550 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIRESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 551 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQASKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 552 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVHNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 553 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFSAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 554 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 555 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 556 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGNEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 557 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARVWLFLRSQEYKKYQTNKTTGNTDKRAFVETWQSFYRKKLKEVWKPAV

SEQ ID NO: 558 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTINTDKRAFVETWQSFYRKKLKEVWKPAV

SEQ ID NO: 559 - protein, 977 aa, Artificial Sequence; identical to SEQ ID NO: 97
  CasX variant

SEQ ID NO: 560 - protein, 977 aa, Artificial Sequence; identical to SEQ ID NO: 98
  CasX variant

SEQ ID NO: 561 - protein, 977 aa, Artificial Sequence; identical to SEQ ID NO: 99
  CasX variant

SEQ ID NO: 562 - protein, 977 aa, Artificial Sequence; identical to SEQ ID NO: 100
  CasX variant

SEQ ID NO: 563 - protein, 977 aa, Artificial Sequence; identical to SEQ ID NO: 101
  CasX variant

SEQ ID NO: 564 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFEDREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 565 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKHPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 566 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLIINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 567 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 568 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 569 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 570 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 571 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 572 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 573 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 574 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 575 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 576 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 577 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 578 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 579 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 580 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 581 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 582 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 583 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 584 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 585 - protein, 979 aa, Artificial Sequence; identical to SEQ ID NO: 433
  CasX variant

SEQ ID NO: 586 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 587 - protein, 978 aa, Artificial Sequence; identical to SEQ ID NO: 96
  CasX variant

SEQ ID NO: 588 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 589 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 590 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 591 - protein, 979 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 592 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 593 - DNA, 64 bp, Artificial Sequence
  PCR2_Rvs_v1_002
caagcagaagacggcatacgagatacatcggtgactggagttcagacgtgtgctcttccgatct

SEQ ID NO: 594 - DNA, 64 bp, Artificial Sequence
  PCR2_Rvs_v1_003
caagcagaagacggcatacgagatgcctaagtgactggagttcagacgtgtgctcttccgatct

SEQ ID NO: 595 - DNA, 64 bp, Artificial Sequence
  PCR2_Rvs_v1_004
caagcagaagacggcatacgagattggtcagtgactggagttcagacgtgtgctcttccgatct

SEQ ID NO: 596 - DNA, 64 bp, Artificial Sequence
  PCR2_Rvs_v1_005
caagcagaagacggcatacgagatcactgtgtgactggagttcagacgtgtgctcttccgatct

SEQ ID NO: 597 - DNA, 64 bp, Artificial Sequence
  PCR2_Rvs_v1_006
caagcagaagacggcatacgagatattggcgtgactggagttcagacgtgtgctcttccgatct

SEQ ID NO: 598 - DNA, 64 bp, Artificial Sequence
  PCR2_Rvs_v1_007
caagcagaagacggcatacgagatgatctggtgactggagttcagacgtgtgctcttccgatct

SEQ ID NO: 599 - DNA, 64 bp, Artificial Sequence
  PCR2_Rvs_v1_008
caagcagaagacggcatacgagattcaagtgtgactggagttcagacgtgtgctcttccgatct

SEQ ID NO: 600 - DNA, 64 bp, Artificial Sequence
  PCR2_Rvs_v1_009
caagcagaagacggcatacgagatctgatcgtgactggagttcagacgtgtgctcttccgatct

SEQ ID NO: 601 - DNA, 64 bp, Artificial Sequence
  PCR2_Rvs_v1_010
caagcagaagacggcatacgagataagctagtgactggagttcagacgtgtgctcttccgatct

SEQ ID NO: 602 - DNA, 64 bp, Artificial Sequence
  PCR2_Rvs_v1_011
caagcagaagacggcatacgagatgtagccgtgactggagttcagacgtgtgctcttccgatct

SEQ ID NO: 603 - DNA, 64 bp, Artificial Sequence
  PCR2_Rvs_v1_012
caagcagaagacggcatacgagattacaaggtgactggagttcagacgtgtgctcttccgatct

SEQ ID NO: 604 - DNA, 64 bp, Artificial Sequence
  PCR2_Rvs_v1_013
caagcagaagacggcatacgagatttgactgtgactggagttcagacgtgtgctcttccgatct

SEQ ID NO: 605 - DNA, 64 bp, Artificial Sequence
  PCR2_Rvs_v1_014
caagcagaagacggcatacgagatggaactgtgactggagttcagacgtgtgctcttccgatct

SEQ ID NO: 606 - DNA, 64 bp, Artificial Sequence
  PCR2_Rvs_v1_015
caagcagaagacggcatacgagattgacatgtgactggagttcagacgtgtgctcttccgatct

SEQ ID NO: 607 - DNA, 64 bp, Artificial Sequence
  PCR2_Rvs_v1_016
caagcagaagacggcatacgagatggacgggtgactggagttcagacgtgtgctcttccgatct

SEQ ID NO: 608 - DNA, 64 bp, Artificial Sequence
  PCR2_Rvs_v1_017
caagcagaagacggcatacgagatctctacgtgactggagttcagacgtgtgctcttccgatct

SEQ ID NO: 609 - DNA, 64 bp, Artificial Sequence
  PCR2_Rvs_v1_018
caagcagaagacggcatacgagatgcggacgtgactggagttcagacgtgtgctcttccgatct

SEQ ID NO: 610 - DNA, 64 bp, Artificial Sequence
  PCR2_Rvs_v1_019
caagcagaagacggcatacgagattttcacgtgactggagttcagacgtgtgctcttccgatct

SEQ ID NO: 611 - DNA, 64 bp, Artificial Sequence
  PCR2_Rvs_v1_020
caagcagaagacggcatacgagatggccacgtgactggagttcagacgtgtgctcttccgatct

SEQ ID NO: 612 - DNA, 64 bp, Artificial Sequence
  PCR2_Rvs_v1_021
caagcagaagacggcatacgagatcgaaacgtgactggagttcagacgtgtgctcttccgatct

SEQ ID NO: 613 - DNA, 64 bp, Artificial Sequence
  PCR2_Rvs_v1_022
caagcagaagacggcatacgagatcgtacggtgactggagttcagacgtgtgctcttccgatct

SEQ ID NO: 614 - DNA, 64 bp, Artificial Sequence
  PCR2_Rvs_v1_023
caagcagaagacggcatacgagatccactcgtgactggagttcagacgtgtgctcttccgatct

SEQ ID NO: 615 - DNA, 64 bp, Artificial Sequence
  PCR2_Rvs_v1_024
caagcagaagacggcatacgagatgctaccgtgactggagttcagacgtgtgctcttccgatct

SEQ ID NO: 616 - DNA, 64 bp, Artificial Sequence
  PCR2_Rvs_v1_025
caagcagaagacggcatacgagatatcagtgtgactggagttcagacgtgtgctcttccgatct

SEQ ID NO: 617 - DNA, 64 bp, Artificial Sequence
  PCR2_Rvs_v1_026
caagcagaagacggcatacgagatgctcatgtgactggagttcagacgtgtgctcttccgatct

SEQ ID NO: 618 - DNA, 64 bp, Artificial Sequence
  PCR2_Rvs_v1_027
caagcagaagacggcatacgagataggaatgtgactggagttcagacgtgtgctcttccgatct

SEQ ID NO: 619 - DNA, 64 bp, Artificial Sequence
  PCR2_Rvs_v1_028
caagcagaagacggcatacgagatcttttggtgactggagttcagacgtgtgctcttccgatct

SEQ ID NO: 620 - DNA, 64 bp, Artificial Sequence
  PCR2_Rvs_v1_029
caagcagaagacggcatacgagattagttggtgactggagttcagacgtgtgctcttccgatct

SEQ ID NO: 621 - DNA, 64 bp, Artificial Sequence
  PCR2_Rvs_v1_030
caagcagaagacggcatacgagatccggtggtgactggagttcagacgtgtgctcttccgatct

SEQ ID NO: 622 - DNA, 64 bp, Artificial Sequence
  PCR2_Rvs_v1_031
caagcagaagacggcatacgagatatcgtggtgactggagttcagacgtgtgctcttccgatct

SEQ ID NO: 623 - DNA, 64 bp, Artificial Sequence
  PCR2_Rvs_v1_032
caagcagaagacggcatacgagattgagtggtgactggagttcagacgtgtgctcttccgatct

SEQ ID NO: 624 - DNA, 64 bp, Artificial Sequence
  PCR2_Rvs_v1_033
caagcagaagacggcatacgagatcgcctggtgactggagttcagacgtgtgctcttccgatct

SEQ ID NO: 625 - DNA, 64 bp, Artificial Sequence
  PCR2_Rvs_v1_034
caagcagaagacggcatacgagatgccatggtgactggagttcagacgtgtgctcttccgatct

SEQ ID NO: 626 - DNA, 64 bp, Artificial Sequence
  PCR2_Rvs_v1_035
caagcagaagacggcatacgagataaaatggtgactggagttcagacgtgtgctcttccgatct

SEQ ID NO: 627 - DNA, 64 bp, Artificial Sequence
  PCR2_Rvs_v1_036
caagcagaagacggcatacgagattgttgggtgactggagttcagacgtgtgctcttccgatct

SEQ ID NO: 628 - DNA, 64 bp, Artificial Sequence
  PCR2_Rvs_v1_037
caagcagaagacggcatacgagatattccggtgactggagttcagacgtgtgctcttccgatct

SEQ ID NO: 629 - DNA, 64 bp, Artificial Sequence
  PCR2_Rvs_v1_038
caagcagaagacggcatacgagatagctaggtgactggagttcagacgtgtgctcttccgatct

SEQ ID NO: 630 - DNA, 64 bp, Artificial Sequence
  PCR2_Rvs_v1_039
caagcagaagacggcatacgagatgtataggtgactggagttcagacgtgtgctcttccgatct

SEQ ID NO: 631 - DNA, 64 bp, Artificial Sequence
  PCR2_Rvs_v1_040
caagcagaagacggcatacgagattctgaggtgactggagttcagacgtgtgctcttccgatct

SEQ ID NO: 632 - DNA, 64 bp, Artificial Sequence
  PCR2_Rvs_v1_041
caagcagaagacggcatacgagatgtcgtcgtgactggagttcagacgtgtgctcttccgatct

SEQ ID NO: 633 - DNA, 64 bp, Artificial Sequence
  PCR2_Rvs_v1_042
caagcagaagacggcatacgagatcgattagtgactggagttcagacgtgtgctcttccgatct

SEQ ID NO: 634 - DNA, 64 bp, Artificial Sequence
  PCR2_Rvs_v1_043
caagcagaagacggcatacgagatgctgtagtgactggagttcagacgtgtgctcttccgatct

SEQ ID NO: 635 - DNA, 64 bp, Artificial Sequence
  PCR2_Rvs_v1_044
caagcagaagacggcatacgagatattatagtgactggagttcagacgtgtgctcttccgatct

SEQ ID NO: 636 - DNA, 64 bp, Artificial Sequence
  PCR2_Rvs_v1_045
caagcagaagacggcatacgagatgaatgagtgactggagttcagacgtgtgctcttccgatct

SEQ ID NO: 637 - DNA, 64 bp, Artificial Sequence
  PCR2_Rvs_v1_046
caagcagaagacggcatacgagattcgggagtgactggagttcagacgtgtgctcttccgatct

SEQ ID NO: 638 - DNA, 64 bp, Artificial Sequence
  PCR2_Rvs_v1_047
caagcagaagacggcatacgagatcttcgagtgactggagttcagacgtgtgctcttccgatct

SEQ ID NO: 639 - DNA, 64 bp, Artificial Sequence
  PCR2_Rvs_v1_048
caagcagaagacggcatacgagattgccgagtgactggagttcagacgtgtgctcttccgatct

SEQ ID NO: 640 - DNA, 61 bp, Artificial Sequence
  PCR2_Rvs_v2_001
caagcagaagacggcatacgagataaccgcgggtgactggagttcagacgtgtgctcttcc

SEQ ID NO: 641 - DNA, 61 bp, Artificial Sequence
  PCR2_Rvs_v2_002
caagcagaagacggcatacgagatggttataagtgactggagttcagacgtgtgctcttcc

SEQ ID NO: 642 - DNA, 61 bp, Artificial Sequence
  PCR2_Rvs_v2_003
caagcagaagacggcatacgagatccaagtccgtgactggagttcagacgtgtgctcttcc

SEQ ID NO: 643 - DNA, 61 bp, Artificial Sequence
  PCR2_Rvs_v2_004
caagcagaagacggcatacgagatttggacttgtgactggagttcagacgtgtgctcttcc

SEQ ID NO: 644 - DNA, 61 bp, Artificial Sequence
  PCR2_Rvs_v2_005
caagcagaagacggcatacgagatcagtggatgtgactggagttcagacgtgtgctcttcc

SEQ ID NO: 645 - DNA, 61 bp, Artificial Sequence
  PCR2_Rvs_v2_006
caagcagaagacggcatacgagattgacaagcgtgactggagttcagacgtgtgctcttcc

SEQ ID NO: 646 - DNA, 61 bp, Artificial Sequence
  PCR2_Rvs_v2_007
caagcagaagacggcatacgagatctagcttggtgactggagttcagacgtgtgctcttcc

SEQ ID NO: 647 - DNA, 61 bp, Artificial Sequence
  PCR2_Rvs_v2_008
caagcagaagacggcatacgagattcgatccagtgactggagttcagacgtgtgctcttcc

SEQ ID NO: 648 - DNA, 61 bp, Artificial Sequence
  PCR2_Rvs_v2_009
caagcagaagacggcatacgagatcctgaactgtgactggagttcagacgtgtgctcttcc

SEQ ID NO: 649 - DNA, 61 bp, Artificial Sequence
  PCR2_Rvs_v2_010
caagcagaagacggcatacgagatttcaggtcgtgactggagttcagacgtgtgctcttcc

SEQ ID NO: 650 - DNA, 61 bp, Artificial Sequence
  PCR2_Rvs_v2_011
caagcagaagacggcatacgagatagtagagagtgactggagttcagacgtgtgctcttcc

SEQ ID NO: 651 - DNA, 61 bp, Artificial Sequence
  PCR2_Rvs_v2_012
caagcagaagacggcatacgagatgacgagaggtgactggagttcagacgtgtgctcttcc

SEQ ID NO: 652 - DNA, 61 bp, Artificial Sequence
  PCR2_Rvs_v2_013
caagcagaagacggcatacgagatagacttgggtgactggagttcagacgtgtgctcttcc

SEQ ID NO: 653 - DNA, 61 bp, Artificial Sequence
  PCR2_Rvs_v2_014
caagcagaagacggcatacgagatgagtccaagtgactggagttcagacgtgtgctcttcc

SEQ ID NO: 654 - DNA, 61 bp, Artificial Sequence
  PCR2_Rvs_v2_015
caagcagaagacggcatacgagatcttaagccgtgactggagttcagacgtgtgctcttcc

SEQ ID NO: 655 - DNA, 61 bp, Artificial Sequence
  PCR2_Rvs_v2_016
caagcagaagacggcatacgagattccggattgtgactggagttcagacgtgtgctcttcc

SEQ ID NO: 656 - DNA, 61 bp, Artificial Sequence
  PCR2_Rvs_v2_017
caagcagaagacggcatacgagatctgtattagtgactggagttcagacgtgtgctcttcc

SEQ ID NO: 657 - DNA, 61 bp, Artificial Sequence
  PCR2_Rvs_v2_018
caagcagaagacggcatacgagattcacgccggtgactggagttcagacgtgtgctcttcc

SEQ ID NO: 658 - DNA, 61 bp, Artificial Sequence
  PCR2_Rvs_v2_019
caagcagaagacggcatacgagatacttacatgtgactggagttcagacgtgtgctcttcc

SEQ ID NO: 659 - DNA, 61 bp, Artificial Sequence
  PCR2_Rvs_v2_020
caagcagaagacggcatacgagatgtccgtgcgtgactggagttcagacgtgtgctcttcc

SEQ ID NO: 660 - DNA, 61 bp, Artificial Sequence
  PCR2_Rvs_v2_021
caagcagaagacggcatacgagataaggtaccgtgactggagttcagacgtgtgctcttcc

SEQ ID NO: 661 - DNA, 61 bp, Artificial Sequence
  PCR2_Rvs_v2_022
caagcagaagacggcatacgagatggaacgttgtgactggagttcagacgtgtgctcttcc

SEQ ID NO: 662 - DNA, 61 bp, Artificial Sequence
  PCR2_Rvs_v2_023
caagcagaagacggcatacgagataattctgcgtgactggagttcagacgtgtgctcttcc

SEQ ID NO: 663 - DNA, 61 bp, Artificial Sequence
  PCR2_Rvs_v2_024
caagcagaagacggcatacgagatggcctcatgtgactggagttcagacgtgtgctcttcc

SEQ ID NO: 664 - DNA, 61 bp, Artificial Sequence
  PCR2_Rvs_v2_025
caagcagaagacggcatacgagatatcttagtgtgactggagttcagacgtgtgctcttcc

SEQ ID NO: 665 - DNA, 61 bp, Artificial Sequence
  PCR2_Rvs_v2_026
caagcagaagacggcatacgagatgctccgacgtgactggagttcagacgtgtgctcttcc

SEQ ID NO: 666 - DNA, 61 bp, Artificial Sequence
  PCR2_Rvs_v2_027
caagcagaagacggcatacgagatataccaaggtgactggagttcagacgtgtgctcttcc

SEQ ID NO: 667 - DNA, 61 bp, Artificial Sequence
  PCR2_Rvs_v2_028
caagcagaagacggcatacgagatgcgttggagtgactggagttcagacgtgtgctcttcc

SEQ ID NO: 668 - DNA, 61 bp, Artificial Sequence
  PCR2_Rvs_v2_029
caagcagaagacggcatacgagatcttcacgggtgactggagttcagacgtgtgctcttcc

SEQ ID NO: 669 - DNA, 61 bp, Artificial Sequence
  PCR2_Rvs_v2_030
caagcagaagacggcatacgagattcctgtaagtgactggagttcagacgtgtgctcttcc

SEQ ID NO: 670 - DNA, 61 bp, Artificial Sequence
  PCR2_Rvs_v2_031
caagcagaagacggcatacgagatagaatgccgtgactggagttcagacgtgtgctcttcc

SEQ ID NO: 671 - DNA, 61 bp, Artificial Sequence
  PCR2_Rvs_v2_032
caagcagaagacggcatacgagatgaggcattgtgactggagttcagacgtgtgctcttcc

SEQ ID NO: 672 - DNA, 61 bp, Artificial Sequence
  PCR2_Rvs_v2_033
caagcagaagacggcatacgagatcctcggtagtgactggagttcagacgtgtgctcttcc

SEQ ID NO: 673 - DNA, 61 bp, Artificial Sequence
  PCR2_Rvs_v2_034
caagcagaagacggcatacgagatttctaacggtgactggagttcagacgtgtgctcttcc

SEQ ID NO: 674 - DNA, 61 bp, Artificial Sequence
  PCR2_Rvs_v2_035
caagcagaagacggcatacgagatatgaggctgtgactggagttcagacgtgtgctcttcc

SEQ ID NO: 675 - DNA, 61 bp, Artificial Sequence
  PCR2_Rvs_v2_036
caagcagaagacggcatacgagatgcagaatcgtgactggagttcagacgtgtgctcttcc

SEQ ID NO: 676 - DNA, 61 bp, Artificial Sequence
  PCR2_Rvs_v2_037
caagcagaagacggcatacgagatcactacgagtgactggagttcagacgtgtgctcttcc

SEQ ID NO: 677 - DNA, 61 bp, Artificial Sequence
  PCR2_Rvs_v2_038
caagcagaagacggcatacgagattgtcgtaggtgactggagttcagacgtgtgctcttcc

SEQ ID NO: 678 - DNA, 61 bp, Artificial Sequence
  PCR2_Rvs_v2_039
caagcagaagacggcatacgagataccacttagtgactggagttcagacgtgtgctcttcc

SEQ ID NO: 679 - DNA, 61 bp, Artificial Sequence
  PCR2_Rvs_v2_040
caagcagaagacggcatacgagatgttgtccggtgactggagttcagacgtgtgctcttcc

SEQ ID NO: 680 - DNA, 61 bp, Artificial Sequence
  PCR2_Rvs_v2_041
caagcagaagacggcatacgagatatccatatgtgactggagttcagacgtgtgctcttcc

SEQ ID NO: 681 - DNA, 61 bp, Artificial Sequence
  PCR2_Rvs_v2_042
caagcagaagacggcatacgagatgcttgcgcgtgactggagttcagacgtgtgctcttcc

SEQ ID NO: 682 - DNA, 61 bp, Artificial Sequence
  PCR2_Rvs_v2_043
caagcagaagacggcatacgagatagtatcttgtgactggagttcagacgtgtgctcttcc

SEQ ID NO: 683 - DNA, 61 bp, Artificial Sequence
  PCR2_Rvs_v2_044
caagcagaagacggcatacgagatgacgctccgtgactggagttcagacgtgtgctcttcc

SEQ ID NO: 684 - DNA, 61 bp, Artificial Sequence
  PCR2_Rvs_v2_045
caagcagaagacggcatacgagatcatgccatgtgactggagttcagacgtgtgctcttcc

SEQ ID NO: 685 - DNA, 61 bp, Artificial Sequence
  PCR2_Rvs_v2_046
caagcagaagacggcatacgagattgcattgcgtgactggagttcagacgtgtgctcttcc

SEQ ID NO: 686 - DNA, 61 bp, Artificial Sequence
  PCR2_Rvs_v2_047
caagcagaagacggcatacgagatattggaacgtgactggagttcagacgtgtgctcttcc

SEQ ID NO: 687 - DNA, 61 bp, Artificial Sequence
  PCR2_Rvs_v2_048
caagcagaagacggcatacgagatgccaaggtgtgactggagttcagacgtgtgctcttcc

SEQ ID NO: 688 - DNA, 58 bp, Artificial Sequence
  PCR2_fwd_v1_univ
aatgatacggcgaccaccgagatctacactctttccctacacgacgctcttccgatct

SEQ ID NO: 689 - DNA, 52 bp, Artificial Sequence; identical to SEQ ID NO: 143
  PCR2_fwd_v2_univ

SEQ ID NO: 690 - DNA, 64 bp, Artificial Sequence
  PCR2_fwd_v2_001
aatgatacggcgaccaccgagatctacacagcgctagacactctttccctacacgacgctcttc

SEQ ID NO: 691 - DNA, 64 bp, Artificial Sequence
  PCR2_fwd_v2_002
aatgatacggcgaccaccgagatctacacgatatcgaacactctttccctacacgacgctcttc

SEQ ID NO: 692 - DNA, 64 bp, Artificial Sequence
  PCR2_fwd_v2_003
aatgatacggcgaccaccgagatctacaccgcagacgacactctttccctacacgacgctcttc

SEQ ID NO: 693 - DNA, 64 bp, Artificial Sequence
  PCR2_fwd_v2_004
aatgatacggcgaccaccgagatctacactatgagtaacactctttccctacacgacgctcttc

SEQ ID NO: 694 - DNA, 64 bp, Artificial Sequence
  PCR2_fwd_v2_005
aatgatacggcgaccaccgagatctacacaggtgcgtacactctttccctacacgacgctcttc

SEQ ID NO: 695 - DNA, 64 bp, Artificial Sequence
  PCR2_fwd_v2_006
aatgatacggcgaccaccgagatctacacgaacatacacactctttccctacacgacgctcttc

SEQ ID NO: 696 - DNA, 64 bp, Artificial Sequence
  PCR2_fwd_v2_007
aatgatacggcgaccaccgagatctacacacatagcgacactctttccctacacgacgctcttc

SEQ ID NO: 697 - DNA, 64 bp, Artificial Sequence
  PCR2_fwd_v2_008
aatgatacggcgaccaccgagatctacacgtgcgataacactctttccctacacgacgctcttc

SEQ ID NO: 698 - DNA, 64 bp, Artificial Sequence
  PCR2_fwd_v2_009
aatgatacggcgaccaccgagatctacacccaacagaacactctttccctacacgacgctcttc

SEQ ID NO: 699 - DNA, 64 bp, Artificial Sequence
  PCR2_fwd_v2_010
aatgatacggcgaccaccgagatctacacttggtgagacactctttccctacacgacgctcttc

SEQ ID NO: 700 - DNA, 64 bp, Artificial Sequence
  PCR2_fwd_v2_011
aatgatacggcgaccaccgagatctacaccgcggttcacactctttccctacacgacgctcttc

SEQ ID NO: 701 - DNA, 64 bp, Artificial Sequence
  PCR2_fwd_v2_012
aatgatacggcgaccaccgagatctacactataacctacactctttccctacacgacgctcttc

SEQ ID NO: 702 - DNA, 89 bp, Artificial Sequence
  guide scaffold sequence
actggcgcttttatctgattactttgagagccatcaccagcgactatgtcgtagtgggtaaagctccctcttcggagggagcatcaaag

SEQ ID NO: 703 - DNA, 97 bp, Artificial Sequence
  guide scaffold sequence
actggcacttttatctgattactttgagagccatcaccagcgactatgtcgtatgggtaaagcgcttacggacttcggtccgtaagaagcatcaaag

SEQ ID NO: 704 - DNA, 96 bp, Artificial Sequence
  guide scaffold sequence
actggcacttctatctgattactctgagagccatcaccagcgactatgtcgtatgggtaaagcgcttacggacttcggtccgtaagaagcatcaga

SEQ ID NO: 705 - DNA, 98 bp, Artificial Sequence
  guide scaffold sequence
actggcgcttctatctgattactctgagagccatcaccagcgactatgtcgtatgggtaaagccgcttacggacttcggtccgtaagaggcatcagag

SEQ ID NO: 706 - DNA, 98 bp, Artificial Sequence
  guide scaffold sequence
actggcacttctatctgattactctgagcgccatcaccagcgactatgtcgtatgggtaaagccgcttacggacttcggtccgtaagaggcatcagag

SEQ ID NO: 707 - DNA, 98 bp, Artificial Sequence
  guide scaffold sequence
actggcgcttctatctgattactctgagcgccatcaccagcgactatgtcgtatgggtaaagccgcttacggacttcggtccgtaagaggcatcagag

SEQ ID NO: 708 - DNA, 98 bp, Artificial Sequence
  guide scaffold sequence
actggcgcttctatctgattactctgagcgccatcaccagcgactatgtcgtatgggtaaagcgccttacggacttcggtccgtaaggagcatcagag

SEQ ID NO: 709 - DNA, 99 bp, Artificial Sequence
  guide scaffold sequence
actggcgcttctatctgattactctgagcgccatcaccagcgactatgtcgtagtgggtaaagccgcttacggacttcggtccgtaagaggcatcagag

SEQ ID NO: 710 - DNA, 98 bp, Artificial Sequence
  guide scaffold sequence
acgggactttctatctgattactctgaagtccctcaccagcgactatgtcgtatgggtaaagccgcttacggacttcggtccgtaagaggcatcagag

SEQ ID NO: 711 - DNA, 98 bp, Artificial Sequence
  guide scaffold sequence
acctgtagttctatctgattactctgactacagtcaccagcgactatgtcgtatgggtaaagccgcttacggacttcggtccgtaagaggcatcagag

SEQ ID NO: 712 - DNA, 89 bp, Artificial Sequence; identical to SEQ ID NO: 702
  guide scaffold sequence

SEQ ID NO: 713 - DNA, 97 bp, Artificial Sequence; identical to SEQ ID NO: 703
  guide scaffold sequence

SEQ ID NO: 714 - DNA, 96 bp, Artificial Sequence; identical to SEQ ID NO: 704
  guide scaffold sequence

SEQ ID NO: 715 - DNA, 98 bp, Artificial Sequence; identical to SEQ ID NO: 705
  guide scaffold sequence

SEQ ID NO: 716 - DNA, 98 bp, Artificial Sequence; identical to SEQ ID NO: 706
  guide scaffold sequence

SEQ ID NO: 717 - DNA, 98 bp, Artificial Sequence; identical to SEQ ID NO: 707
  guide scaffold sequence

SEQ ID NO: 718 - DNA, 98 bp, Artificial Sequence; identical to SEQ ID NO: 708
  guide scaffold sequence

SEQ ID NO: 719 - DNA, 99 bp, Artificial Sequence; identical to SEQ ID NO: 709
  guide scaffold sequence

SEQ ID NO: 720 - DNA, 98 bp, Artificial Sequence; identical to SEQ ID NO: 710
  guide scaffold sequence

SEQ ID NO: 721 - DNA, 98 bp, Artificial Sequence; identical to SEQ ID NO: 711
  guide scaffold sequence

SEQ ID NO: 722 - DNA, 89 bp, Artificial Sequence; identical to SEQ ID NO: 702
  guide scaffold sequence

SEQ ID NO: 723 - DNA, 99 bp, Artificial Sequence; identical to SEQ ID NO: 709
  guide scaffold sequence

SEQ ID NO: 724 - DNA, 89 bp, Artificial Sequence; identical to SEQ ID NO: 702
  guide scaffold sequence

SEQ ID NO: 725 - DNA, 99 bp, Artificial Sequence; identical to SEQ ID NO: 709
  guide scaffold sequence

SEQ ID NO: 726 - DNA, 99 bp, Artificial Sequence; identical to SEQ ID NO: 709
  guide scaffold sequence

SEQ ID NO: 727 - DNA, 109 bp, Artificial Sequence
  gRNA
actggcgcttttatctgattactttgagagccatcaccagcgactatgtcgtagtgggtaaagctccctcttcggagggagcatcaaagctgcattctagttgtggttt

SEQ ID NO: 728 - DNA, 117 bp, Artificial Sequence
  gRNA
actggcacttttatctgattactttgagagccatcaccagcgactatgtcgtatgggtaaagcgcttacggacttcggtccgtaagaagcatcaaagctgcattctagttgtggttt

SEQ ID NO: 729 - DNA, 117 bp, Artificial Sequence
  gRNA
actggcacttctatctgattactctgagagccatcaccagcgactatgtcgtatgggtaaagcgcttacggacttcggtccgtaagaagcatcagagctgcattctagttgtggttt

SEQ ID NO: 730 - DNA, 118 bp, Artificial Sequence
  gRNA
actggcgcttctatctgattactctgagagccatcaccagcgactatgtcgtatgggtaaagccgcttacggacttcggtccgtaagaggcatcagagctgcattctagttgtggttt

SEQ ID NO: 731 - DNA, 118 bp, Artificial Sequence
  gRNA
actggcacttctatctgattactctgagcgccatcaccagcgactatgtcgtatgggtaaagccgcttacggacttcggtccgtaagaggcatcagagctgcattctagttgtggttt

SEQ ID NO: 732 - DNA, 118 bp, Artificial Sequence
  gRNA
actggcgcttctatctgattactctgagcgccatcaccagcgactatgtcgtatgggtaaagccgcttacggacttcggtccgtaagaggcatcagagctgcattctagttgtggttt

SEQ ID NO: 733 - DNA, 118 bp, Artificial Sequence
  gRNA
actggcgcttctatctgattactctgagcgccatcaccagcgactatgtcgtatgggtaaagcgccttacggacttcggtccgtaaggagcatcagagctgcattctagttgtggttt

SEQ ID NO: 734 - DNA, 118 bp, Artificial Sequence
  gRNA
actggcgcttctatctgattactctgagcgccatcaccagcgactatgtcgtagtgggtaaagccgcttacggacttcggtccgtaagaggcatcagagctgcattctagttgtggtt

SEQ ID NO: 735 - DNA, 117 bp, Artificial Sequence
  gRNA
acgggactttctatctgattactctgaagtccctcaccagcgactatgtcgtatgggtaaagccgcttacggacttcggtccgtaagaggcatcagagctgcattctagttgtggtt

SEQ ID NO: 736 - DNA, 117 bp, Artificial Sequence
  gRNA
acctgtagttctatctgattactctgactacagtcaccagcgactatgtcgtatgggtaaagccgcttacggacttcggtccgtaagaggcatcagagctgcattctagttgtggtt

SEQ ID NO: 737 - DNA, 109 bp, Artificial Sequence
  gRNA
actggcgcttttatctgattactttgagagccatcaccagcgactatgtcgtagtgggtaaagctccctcttcggagggagcatcaaagaaggggctccgcaccacgcc

SEQ ID NO: 738 - DNA, 117 bp, Artificial Sequence
  gRNA
actggcacttttatctgattactttgagagccatcaccagcgactatgtcgtatgggtaaagcgcttacggacttcggtccgtaagaagcatcaaagaaggggctccgcaccacgcc

SEQ ID NO: 739 - DNA, 116 bp, Artificial Sequence
  gRNA
actggcacttctatctgattactctgagagccatcaccagcgactatgtcgtatgggtaaagcgcttacggacttcggtccgtaagaagcatcagaaaggggctccgcaccacgcc

SEQ ID NO: 740 - DNA, 118 bp, Artificial Sequence
  gRNA
actggcgcttctatctgattactctgagagccatcaccagcgactatgtcgtatgggtaaagccgcttacggacttcggtccgtaagaggcatcagagaaggggctccgcaccacgcc

SEQ ID NO: 741 - DNA, 118 bp, Artificial Sequence
  gRNA
actggcacttctatctgattactctgagcgccatcaccagcgactatgtcgtatgggtaaagccgcttacggacttcggtccgtaagaggcatcagagaaggggctccgcaccacgcc

SEQ ID NO: 742 - DNA, 118 bp, Artificial Sequence
  gRNA
actggcgcttctatctgattactctgagcgccatcaccagcgactatgtcgtatgggtaaagccgcttacggacttcggtccgtaagaggcatcagagaaggggctccgcaccacgcc

SEQ ID NO: 743 - DNA, 118 bp, Artificial Sequence
  gRNA
actggcgcttctatctgattactctgagcgccatcaccagcgactatgtcgtatgggtaaagcgccttacggacttcggtccgtaaggagcatcagagaaggggctccgcaccacgcc

SEQ ID NO: 744 - DNA, 119 bp, Artificial Sequence
  gRNA
actggcgcttctatctgattactctgagcgccatcaccagcgactatgtcgtagtgggtaaagccgcttacggacttcggtccgtaagaggcatcagagaaggggctccgcaccacgcc

SEQ ID NO: 745 - DNA, 118 bp, Artificial Sequence
  gRNA
acgggactttctatctgattactctgaagtccctcaccagcgactatgtcgtatgggtaaagccgcttacggacttcggtccgtaagaggcatcagagaaggggctccgcaccacgcc

SEQ ID NO: 746 - DNA, 118 bp, Artificial Sequence
  gRNA
acctgtagttctatctgattactctgactacagtcaccagcgactatgtcgtatgggtaaagccgcttacggacttcggtccgtaagaggcatcagagaaggggctccgcaccacgcc

SEQ ID NO: 747 - DNA, 109 bp, Artificial Sequence
  gRNA
actggcgcttttatctgattactttgagagccatcaccagcgactatgtcgtagtgggtaaagctccctcttcggagggagcatcaaagaagtggctccgcaccacgcc

SEQ ID NO: 748 - DNA, 119 bp, Artificial Sequence
  gRNA
actggcgcttctatctgattactctgagcgccatcaccagcgactatgtcgtagtgggtaaagccgcttacggacttcggtccgtaagaggcatcagagaagtggctccgcaccacgcc

SEQ ID NO: 749 - DNA, 109 bp, Artificial Sequence
  gRNA
actggcgcttttatctgattactttgagagccatcaccagcgactatgtcgtagtgggtaaagctccctcttcggagggagcatcaaagaaggggctgcgtaccacacc

SEQ ID NO: 750 - DNA, 119 bp, Artificial Sequence
  gRNA
actggcgcttctatctgattactctgagcgccatcaccagcgactatgtcgtagtgggtaaagccgcttacggacttcggtccgtaagaggcatcagagaaggggctgcgtaccacacc

SEQ ID NO: 751 - DNA, 117 bp, Artificial Sequence
  gRNA
actggcgcttctatctgattactctgagcgccatcaccagcgactatgtcgtagtgggtaaagccgcttacggacttcggtccgtaagaggcatcagaggggtcttcgagaagaccc

SEQ ID NO: 752 - DNA, 29 bp, Artificial Sequence
  CMV Fwd primer
catctacgtattagtcatcgctattacca

SEQ ID NO: 753 - DNA, 21 bp, Artificial Sequence
  CMV Rev primer
gaaatccccgtgagtcaaacc

SEQ ID NO: 754 - DNA, 17 bp, Artificial Sequence
  CMV probe
tcaatgggcgtggatag

SEQ ID NO: 755 - DNA, 21 bp, Artificial Sequence
  AAV2 ITR Fwd primer
ggaacccctagtgatggagtt

SEQ ID NO: 756 - DNA, 16 bp, Artificial Sequence
  AAV2 ITR Rev primer
cggcctcagtgagcga

SEQ ID NO: 757 - DNA, 21 bp, Artificial Sequence
  AAV2 ITR probe
cactccctctctgcgcgctcg

SEQ ID NO: 758 - DNA, 62 bp, Artificial Sequence
  Rho Fwd primer
  misc_feature (34)..(40): n is any nucleotide
acactctttccctacacgacgctcttccgatctnnnnnnngcagccttggtctctgtctacg

SEQ ID NO: 759 - DNA, 57 bp, Artificial Sequence
  Rho Rev primer
gtgactggagttcagacgtgtgctcttccgatctgccccagtctctctgctcatacc

SEQ ID NO: 760 - protein, 1039 aa, Artificial Sequence
  CasX construct WT Cas X sequence of SEQ ID NO: 2 fused to an N terminal NLS
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVAPKKKRKVSENLYFQGSAWSHPQFEKGGGSGGGSGGSAWSHPQFEKGRGSGC

SEQ ID NO: 761 - protein, 1040 aa, Artificial Sequence
  CasX construct CasX 119
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVPPAPKKKRKVSENLYFQGSAWSHPQFEKGGGSGGGSGGSAWSHPQFEKGRGSGC

SEQ ID NO: 762 - protein, 1040 aa, Artificial Sequence
  CasX construct CasX 438
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVPPAPKKKRKVSENLYFQGSAWSHPQFEKGGGSGGGSGGSAWSHPQFEKGRGSGC

SEQ ID NO: 763 - protein, 1040 aa, Artificial Sequence
  CasX construct CasX 457
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVPPAPKKKRKVSENLYFQGSAWSHPQFEKGGGSGGGSGGSAWSHPQFEKGRGSGC

SEQ ID NO: 764 - protein, 976 aa, Artificial Sequence; identical to SEQ ID NO: 315
  CasX construct CasX 119

SEQ ID NO: 765 - protein, 976 aa, Artificial Sequence
  CasX construct CasX 457
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 766 - protein, 976 aa, Artificial Sequence
  CasX construct CasX 438
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 767 - protein, 987 aa, Artificial Sequence
  CasX construct CasX 278
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 768 - protein, 986 aa, Artificial Sequence
  CasX construct CasX 279
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 769 - protein, 996 aa, Artificial Sequence
  CasX construct CasX 280
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 770 - protein, 1006 aa, Artificial Sequence
  CasX construct CasX 285
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPHKKKHPDASVNFSEFSK

SEQ ID NO: 771 - protein, 1007 aa, Artificial Sequence
  CasX construct CasX 286
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPQRPGPYDRPQRPGPYDRP

SEQ ID NO: 772 - protein, 1005 aa, Artificial Sequence
  CasX construct CasX 287
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPLSPSLSPLLSPSLSPL

SEQ ID NO: 773 - protein, 1008 aa, Artificial Sequence
  CasX construct CasX 288
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPRGKGGKGLGKGGAKRHRK

SEQ ID NO: 774 - protein, 1013 aa, Artificial Sequence
  CasX construct CasX 290
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPSRRRKANPTKLSENAKKLAKEVEN

SEQ ID NO: 775 - protein, 998 aa, Artificial Sequence
  CasX construct CasX 291
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 776 - protein, 997 aa, Artificial Sequence
  CasX construct CasX 293
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRSFSKAF

SEQ ID NO: 777 - protein, 1008 aa, Artificial Sequence
  CasX construct CasX 300
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRGINDRNFWRGENERKTR

SEQ ID NO: 778 - protein, 1007 aa, Artificial Sequence
  CasX construct CasX 492
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 779 - protein, 1009 aa, Artificial Sequence
  CasX construct CasX 493
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 780 - protein, 997 aa, Artificial Sequence
  CasX 387 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 781 - protein, 1005 aa, Artificial Sequence
  CasX 395 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVTSPKKKRKV

SEQ ID NO: 782 - protein, 996 aa, Artificial Sequence
  CasX 485 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 783 - protein, 996 aa, Artificial Sequence
  CasX 486 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 784 - protein, 996 aa, Artificial Sequence
  CasX 487 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 785 - protein, 997 aa, Artificial Sequence
  CasX 488 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 786 - protein, 997 aa, Artificial Sequence
  CasX 489 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 787 - protein, 997 aa, Artificial Sequence
  CasX 490 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 788 - protein, 997 aa, Artificial Sequence
  CasX 491 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 789 - protein, 997 aa, Artificial Sequence
  CasX 494 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 790 - protein, 977 aa, Artificial Sequence; identical to SEQ ID NO: 258
  CasX protein variant

SEQ ID NO: 791 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 792 - protein, 977 aa, Artificial Sequence; identical to SEQ ID NO: 260
  CasX protein variant

SEQ ID NO: 793 - protein, 978 aa, Artificial Sequence; identical to SEQ ID NO: 261
  CasX protein variant

SEQ ID NO: 794 - protein, 978 aa, Artificial Sequence; identical to SEQ ID NO: 262
  CasX protein variant

SEQ ID NO: 795 - protein, 978 aa, Artificial Sequence; identical to SEQ ID NO: 263
  CasX protein variant

SEQ ID NO: 796 - protein, 977 aa, Artificial Sequence; identical to SEQ ID NO: 264
  CasX protein variant

SEQ ID NO: 797 - protein, 977 aa, Artificial Sequence; identical to SEQ ID NO: 265
  CasX protein variant

SEQ ID NO: 798 - protein, 977 aa, Artificial Sequence; identical to SEQ ID NO: 266
  CasX protein variant

SEQ ID NO: 799 - protein, 977 aa, Artificial Sequence; identical to SEQ ID NO: 267
  CasX protein variant

SEQ ID NO: 800 - protein, 978 aa, Artificial Sequence; identical to SEQ ID NO: 268
  CasX protein variant

SEQ ID NO: 801 - protein, 977 aa, Artificial Sequence; identical to SEQ ID NO: 269
  CasX protein variant

SEQ ID NO: 802 - protein, 977 aa, Artificial Sequence; identical to SEQ ID NO: 270
  CasX protein variant

SEQ ID NO: 803 - protein, 977 aa, Artificial Sequence; identical to SEQ ID NO: 271
  CasX protein variant

SEQ ID NO: 804 - protein, 977 aa, Artificial Sequence; identical to SEQ ID NO: 272
  CasX protein variant

SEQ ID NO: 805 - protein, 977 aa, Artificial Sequence; identical to SEQ ID NO: 273
  CasX protein variant

SEQ ID NO: 806 - protein, 978 aa, Artificial Sequence; identical to SEQ ID NO: 274
  CasX protein variant

SEQ ID NO: 807 - protein, 978 aa, Artificial Sequence; identical to SEQ ID NO: 275
  CasX protein variant

SEQ ID NO: 808 - protein, 977 aa, Artificial Sequence; identical to SEQ ID NO: 276
  CasX protein variant

SEQ ID NO: 809 - protein, 977 aa, Artificial Sequence; identical to SEQ ID NO: 277
  CasX protein variant

SEQ ID NO: 810 - protein, 977 aa, Artificial Sequence; identical to SEQ ID NO: 278
  CasX protein variant

SEQ ID NO: 811 - protein, 978 aa, Artificial Sequence; identical to SEQ ID NO: 279
  CasX protein variant

SEQ ID NO: 812 - protein, 978 aa, Artificial Sequence; identical to SEQ ID NO: 280
  CasX protein variant

SEQ ID NO: 813 - protein, 977 aa, Artificial Sequence; identical to SEQ ID NO: 281
  CasX protein variant

SEQ ID NO: 814 - protein, 978 aa, Artificial Sequence; identical to SEQ ID NO: 282
  CasX protein variant

SEQ ID NO: 815 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEMLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 816 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSERDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 817 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 818 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 819 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFAANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 820 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 821 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRNEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 822 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLGSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 823 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 824 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGKPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 825 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 826 - protein, 980 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTASYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 827 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFHRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 828 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 829 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDWLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 830 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 831 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 832 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARMWLFLRSQEYKKYQTNKTTGNTDKRAFVETWQSFYRKKLKEVWKPAV

SEQ ID NO: 833 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 834 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 835 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAQKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 836 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNKNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 837 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 838 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFQRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 839 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAAYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 840 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 841 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 842 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEMLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 843 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADTMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 844 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLQSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 845 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 846 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 847 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYSKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 848 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEKRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 849 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 850 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 851 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFRRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 852 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTTRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 853 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNRCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 854 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGEVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 855 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 856 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSKEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 857 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIHESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 858 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 859 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIRAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 860 - protein, 978 aa, Artificial Sequence; identical to SEQ ID NO: 824
  CasX protein variant

SEQ ID NO: 861 - protein, 978 aa, Artificial Sequence
  CasX protein variant
MQEIKRINKIRRRLVKDSNTKKAGRTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 862 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWRPAV

SEQ ID NO: 863 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFMETWQSFYRKKLKEVWKPAV

SEQ ID NO: 864 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 865 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSSTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 866 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGTTDKRAFVETWQSFYRKKLKEVWKPAV

SEQ ID NO: 867 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWQPAV

SEQ ID NO: 868 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRRGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 869 - protein, 977 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 870 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLWYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 871 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERRENEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 872 - protein, 978 aa, Artificial Sequence
  CasX protein variant
MQEIKRFNKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 873 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYKINKTTGNTDKRAFVETWQSFYRKKLKEVWKPAV

SEQ ID NO: 874 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFEDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 875 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSAEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 876 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 877 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSQEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 878 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLANDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 879 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIKAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 880 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPRKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 881 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEMLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 882 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVKWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 883 - protein, 980 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLASPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 884 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLGLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 885 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 886 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEKLLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 887 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDRRAFVETWQSFYRKKLKEVWKPAV

SEQ ID NO: 888 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWKKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 889 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERRKNEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 890 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPQQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 891 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNNLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 892 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLRVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 893 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIHGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 894 - protein, 978 aa, Artificial Sequence
  CasX protein variant
MQEIKRINKIRRRLVKDSNTKKAGKTGPMKTLLVRVMTPDLRERLENLRKKPKNIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 895 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGEPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 896 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERRANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 897 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPDTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 898 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKGIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 899 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKPPGNTDKRAFVETWQSFYRKKLKEVWKPAV

SEQ ID NO: 900 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKFTLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 901 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLMKKRFSHRPVQEKFVCLNCGFETHADEQAALNIARSWLFLRSQEYKKYQTNKTTGNTDKRAFVETWQSFYRKKLKEVWKPAV

SEQ ID NO: 902 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKRGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 903 - protein, 978 aa, Artificial Sequence; identical to SEQ ID NO: 902
  CasX protein variant

SEQ ID NO: 904 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGGPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 905 - protein, 978 aa, Artificial Sequence; identical to SEQ ID NO: 845
  CasX protein variant

SEQ ID NO: 906 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNGRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 907 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVENVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 908 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIKAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 909 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDQKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 910 - protein, 978 aa, Artificial Sequence
  CasX protein variant
MQEIKRINKIRRRLVKDSNTKKAGKTGPMKTLLVRVMTPDLRERLENLRKKPENFPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 911 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVQQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 912 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDKFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 913 - protein, 980 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKASTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 914 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTREDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 915 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRAELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 916 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVEREANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 917 - protein, 978 aa, Artificial Sequence
  CasX protein variant
MQEIKRINKIRRRLVKDSNTKKAGQTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 918 - protein, 980 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSASKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 919 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCEQKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 920 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFKANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 921 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHINYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 922 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNDDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 923 - protein, 978 aa, Artificial Sequence; identical to SEQ ID NO: 881
  CasX protein variant

SEQ ID NO: 924 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDASMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 925 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWKNLAGYKRQEALLPYLSSEEDRKKGKKFARYQFGDLLLHLEKKHGEDWGKVYDEAWERSDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 926 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSIGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 927 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYQKYQTNKTTGNTDKRAFVETWQSFYRKKLKEVWKPAV

SEQ ID NO: 928 - protein, 978 aa, Artificial Sequence
  CasX protein variant
MQEIKRINKIRRRLVKDSNTKKAGKTGPMKTLLVRVMTPDLRERLEDLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 929 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFMALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 930 - protein, 978 aa, Artificial Sequence
  CasX protein variant
MQEIKRINKIRRRLVKDSNTKKAGKTDPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 931 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRLELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 932 - protein, 979 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLASSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 933 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLSDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 934 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIAWANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 935 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDSMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 936 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVARPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 937 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDKVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 938 - protein, 980 aa, Artificial Sequence; identical to SEQ ID NO: 918
  CasX protein variant

SEQ ID NO: 939 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKYGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 940 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSRTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 941 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVDLTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 942 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGEVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 943 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILIIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 944 - protein, 978 aa, Artificial Sequence
  CasX protein variant
MQEIKRINKIRRRLVKDSNTKKAGKTGPRKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 945 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQPNKTTGNTDKRAFVETWQSFYRKKLKEVWKPAV

SEQ ID NO: 946 - protein, 979 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGLRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 947 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNDRLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 948 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGKVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 949 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGRRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 950 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCKLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 951 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKVKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 952 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGEFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 953 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLATEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 954 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPSAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 955 - protein, 978 aa, Artificial Sequence
  CasX protein variant
MQEIKRINKIRRRLVKDSNTKKAGKTGPEKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 956 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVTSFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 957 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSNACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 958 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSFHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 959 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRSTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 960 - protein, 979 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRAGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 961 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRANASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 962 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVRPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 963 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRPKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 964 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKIQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 965 - protein, 979 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGTESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 966 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDIGRFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 967 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKNASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 968 - protein, 979 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGPESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 969 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVRKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 970 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVGKPAV

SEQ ID NO: 971 - protein, 979 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAMERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 972 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKRIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 973 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYSSKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 974 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRKIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 975 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFNRKKLKEVWKPAV

SEQ ID NO: 976 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSERERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 977 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRIYTVINKKSGEIVPMEVNFNFDDPNLIILPLAFGKRQGREFIWNDLLSLETGSLKLANGRVIEKTLYNRRTRQDEPALFVALTFERREVLASSNIKPMNLIGIDRGENIPAVIALTDPEGCPLSRFKDSLGNPTHILRIDESYKEKQRTIQAAKEVEQRRAGGYSRKYASKAKNLADDMVRNTARDLLYYAVTQDSMLIFENLSRGFGRQGKRTFMAERQYTRMEDWLTAKLAYEGLPSKTYLSKTLAQYTSKTCSNCGFTITSPDYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 978 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIHRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 979 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYVSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 980 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLADEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 981 - protein, 978 aa, Artificial Sequence; identical to SEQ ID NO: 915
  CasX protein variant

SEQ ID NO: 982 - protein, 978 aa, Artificial Sequence
  CasX protein variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPPEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 983 - protein, 81 aa, Artificial Sequence
  nuclear localization signal
PAAKRVKLDGGKRTADGSEFESPKKKRKVAEAAAKEAAAKEAAAKAPGSRDISRQEIKRINKIRRRLVKDSNTKKAGKTGP

SEQ ID NO: 984 - protein, 64 aa, Artificial Sequence
  nuclear localization signal
PAAKRVKLDGGKRTADGSEFESPKKKRKVPGSRDISRQEIKRINKIRRRLVKDSNTKKAGKTGP

SEQ ID NO: 985 - protein, 55 aa, Artificial Sequence
  nuclear localization signal
PAAKRVKLDGGSPKKKRKVGGSSRDISRQEIKRINKIRRRLVKDSNTKKAGKTGP

SEQ ID NO: 986 - protein, 54 aa, Artificial Sequence
  nuclear localization signal
PAAKRVKLDPPPPKKKRKVPGSRDISRQEIKRINKIRRRLVKDSNTKKAGKTGP

SEQ ID NO: 987 - protein, 45 aa, Artificial Sequence
  nuclear localization signal
PAAKRVKLDPGRSRDISRQEIKRINKIRRRLVKDSNTKKAGKTGP

SEQ ID NO: 988 - protein, 40 aa, Artificial Sequence
  nuclear localization signal
PKKKRKVSRDISRQEIKRINKIRRRLVKDSNTKKAGKTGP

SEQ ID NO: 989 - protein, 36 aa, Artificial Sequence
  nuclear localization signal
PKKKRKVSRQEIKRINKIRRRLVKDSNTKKAGKTGP

SEQ ID NO: 990 - protein, 38 aa, Artificial Sequence
  nuclear localization signal
PAAKRVKLDSRQEIKRINKIRRRLVKDSNTKKAGKTGP

SEQ ID NO: 991 - protein, 21 aa, Artificial Sequence
  nuclear localization signal
TSPKKKRKVALEYPYDVPDYA

SEQ ID NO: 992 - protein, 33 aa, Artificial Sequence
  nuclear localization signal
TLESKRPAATKKAGQAKKKKAPGEYPYDVPDYA

SEQ ID NO: 993 - protein, 27 aa, Artificial Sequence
  nuclear localization signal
GSKRPAATKKAGQAKKKKYPYDVPDYA

SEQ ID NO: 994 - protein, 52 aa, Artificial Sequence
  nuclear localization signal
TLESKRPAATKKAGQAKKKKGGSKRPAATKKAGQAKKKKAPGEYPYDVPDYA

SEQ ID NO: 995 - protein, 77 aa, Artificial Sequence
  nuclear localization signal
TLESKRPAATKKAGQAKKKKGGSKRPAATKKAGQAKKKKGGSKRPAATKKAGQAKKKKGGSKRPAATKKAGQAKKKK

SEQ ID NO: 996 - protein, 115 aa, Artificial Sequence
  nuclear localization signal
TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKK

SEQ ID NO: 997 - protein, 41 aa, Artificial Sequence
  nuclear localization signal
TLESPKKKRKVGGSPKKKRKVGGSPKKKRKVGGSPKKKRKV

SEQ ID NO: 998 - protein, 49 aa, Artificial Sequence
  nuclear localization signal
TLESPAAKRVKLDGGSPAAKRVKLDGGSPAAKRVKLDGGSPAAKRVKLD

SEQ ID NO: 999 - protein, 73 aa, Artificial Sequence
  nuclear localization signal
TLESPAAKRVKLDGGSPAAKRVKLDGGSPAAKRVKLDGGSPAAKRVKLDGGSPAAKRVKLDGGSPAAKRVKLD

SEQ ID NO: 1000 - protein, 20 aa, Artificial Sequence
  nuclear localization signal
TLESKRPAATKKAGQAKKKK

SEQ ID NO: 1001 - protein, 39 aa, Artificial Sequence
  nuclear localization signal
TLESKRPAATKKAGQAKKKKGGSKRPAATKKAGQAKKKK

SEQ ID NO: 1002 - protein, 13 aa, Artificial Sequence
  nuclear localization signal
TLEGGSPKKKRKV

SEQ ID NO: 1003 - protein, 34 aa, Artificial Sequence
  nuclear localization signal
TLEVGPKRTADSQHSTPPKTKRKVEFEPKKKRKV

SEQ ID NO: 1004 - protein, 40 aa, Artificial Sequence
  nuclear localization signal
TLEVGGGSGGGSKRTADSQHSTPPKTKRKVEFEPKKKRKV

SEQ ID NO: 1005 - protein, 49 aa, Artificial Sequence
  nuclear localization signal
TLEVAEAAAKEAAAKEAAAKAKRTADSQHSTPPKTKRKVEFEPKKKRKV

SEQ ID NO: 1006 - protein, 44 aa, Artificial Sequence
  nuclear localization signal
TLEVGPPKKKRKVGGSKRTADSQHSTPPKTKRKVEFEPKKKRKV

SEQ ID NO: 1007 - protein, 32 aa, Artificial Sequence
  nuclear localization signal
TLEVGPAEAAAKEAAAKEAAAKAPAAKRVKLD

SEQ ID NO: 1008 - protein, 27 aa, Artificial Sequence
  nuclear localization signal
TLEVGPGGGSGGGSGGGSPAAKRVKLD

SEQ ID NO: 1009 - protein, 25 aa, Artificial Sequence
  nuclear localization signal
TLEVGPPKKKRKVPPPPAAKRVKLD

SEQ ID NO: 1010 - protein, 15 aa, Artificial Sequence
  nuclear localization signal
TLEVGPPAAKRVKLD

SEQ ID NO: 1011 - protein, 18 aa, Artificial Sequence
  nuclear localization signal
GSKRPAATKKAGQAKKKK

SEQ ID NO: 1012 - protein, 9 aa, Artificial Sequence
  nuclear localization signal
GSPKKKRKV

SEQ ID NO: 1013 - protein, 36 aa, Artificial Sequence
  nuclear localization signal
GGGSGGGSKRTADSQHSTPPKTKRKVEFEPKKKRKV

SEQ ID NO: 1014 - protein, 40 aa, Artificial Sequence
  nuclear localization signal
GPPKKKRKVGGSKRTADSQHSTPPKTKRKVEFEPKKKRKV

SEQ ID NO: 1015 - protein, 26 aa, Artificial Sequence
  nuclear localization signal
TGGGPGGGAAAGSGSPKKKRKVGSGS

SEQ ID NO: 1016 - protein, 30 aa, Artificial Sequence
  nuclear localization signal
GPKRTADSQHSTPPKTKRKVEFEPKKKRKV

SEQ ID NO: 1017 - protein, 45 aa, Artificial Sequence
  nuclear localization signal
AEAAAKEAAAKEAAAKAKRTADSQHSTPPKTKRKVEFEPKKKRKV

SEQ ID NO: 1018 - protein, 21 aa, Artificial Sequence
  nuclear localization signal
GPPKKKRKVPPPPAAKRVKLD

SEQ ID NO: 1019 - protein, 71 aa, Artificial Sequence
  nuclear localization signal
GSPAAKRVKLDGGSPAAKRVKLDGGSPAAKRVKLDGGSPAAKRVKLDGGSPAAKRVKLDGGSPAAKRVKLD

SEQ ID NO: 1020 - protein, 41 aa, Artificial Sequence
  nuclear localization signal
GSPAAKRVKLGGSPAAKRVKLGGSPKKKRKVGGSPKKKRKV

SEQ ID NO: 1021 - protein, 37 aa, Artificial Sequence
  nuclear localization signal
GSKRPAATKKAGQAKKKKGGSKRPAATKKAGQAKKKK

SEQ ID NO: 1022 - RNA, 46 nt, Artificial Sequence
  triplex loop
  misc_feature (37)..(39): n is any ribonucleotide
acuggcgcuuuuaucugauuacuuugagagccaucannnaucaaag

SEQ ID NO: 1023 - protein, 5 aa, Artificial Sequence
  linker
  SITE (2)..(5): individual amino acid residues may be present or absent
GGGGG

SEQ ID NO: 1024 - protein, 10 aa, Artificial Sequence
  linker
  SITE (3)..(4): grouped amino acid residues may be present or absent
  SITE (5)..(6): grouped amino acid residues may be present or absent
  SITE (7)..(8): grouped amino acid residues may be present or absent
  SITE (9)..(10): grouped amino acid residues may be present or absent
GSGSGSGSGS

SEQ ID NO: 1025 - protein, 17 aa, Artificial Sequence
  linker
AEAAAKEAAAKEAAAKA

SEQ ID NO: 1026 - protein, 50 aa, Artificial Sequence
  peptide transduction domain
  SITE (4)..(50): individual amino acid residues may be present or absent
RRRRRRRRRRRRRRRRRRRRRRRRRRRRRRRRRRRRRRRRRRRRRRRRRR

SEQ ID NO: 1027 - DNA, 2931 bp, Artificial Sequence; identical to SEQ ID NO: 76
  CasX 488 variant

SEQ ID NO: 1028 - DNA, 2931 bp, Artificial Sequence; identical to SEQ ID NO: 77
  CasX 491 variant

SEQ ID NO: 1029 - DNA, 2934 bp, Artificial Sequence; identical to SEQ ID NO: 78
  CasX 515 variant

SEQ ID NO: 1030 - DNA, 2934 bp, Artificial Sequence; identical to SEQ ID NO: 79
  CasX 527 variant

SEQ ID NO: 1031 - DNA, 2934 bp, Artificial Sequence; identical to SEQ ID NO: 80
  CasX 535

SEQ ID NO: 1032 - DNA, 2934 bp, Artificial Sequence; identical to SEQ ID NO: 81
  CasX 536 variant

SEQ ID NO: 1033 - DNA, 2934 bp, Artificial Sequence; identical to SEQ ID NO: 82
  CasX 537 variant

SEQ ID NO: 1034 - DNA, 2934 bp, Artificial Sequence; identical to SEQ ID NO: 83
  CasX 583 variant

SEQ ID NO: 1035 - DNA, 2931 bp, Artificial Sequence; identical to SEQ ID NO: 84
  CasX 660 variant

SEQ ID NO: 1036 - DNA, 2931 bp, Artificial Sequence; identical to SEQ ID NO: 85
  CasX 661

SEQ ID NO: 1037 - DNA, 2931 bp, Artificial Sequence; identical to SEQ ID NO: 86
  CasX 662 variant

SEQ ID NO: 1038 - DNA, 2931 bp, Artificial Sequence; identical to SEQ ID NO: 87
  CasX 663 variant

SEQ ID NO: 1039 - DNA, 2931 bp, Artificial Sequence; identical to SEQ ID NO: 88
  CasX 664 variant

SEQ ID NO: 1040 - DNA, 2937 bp, Artificial Sequence
  CasX 668 variant
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 1041 - DNA, 2937 bp, Artificial Sequence
  CasX 670 variant
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccggcgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 1042 - DNA, 2934 bp, Artificial Sequence
  CasX 672 variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 1043 - DNA, 2937 bp, Artificial Sequence
  CasX 676 variant
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 1044 - DNA, 2937 bp, Artificial Sequence
  CasX 677 variant
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccggcgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 1045 - protein, 977 aa, Artificial Sequence; identical to SEQ ID NO: 89
  CasX 488 variant

SEQ ID NO: 1046 - protein, 977 aa, Artificial Sequence; identical to SEQ ID NO: 90
  CasX 491 variant

SEQ ID NO: 1047 - protein, 978 aa, Artificial Sequence; identical to SEQ ID NO: 91
  CasX 515 variant

SEQ ID NO: 1048 - protein, 978 aa, Artificial Sequence; identical to SEQ ID NO: 92
  CasX 527 variant

SEQ ID NO: 1049 - protein, 978 aa, Artificial Sequence; identical to SEQ ID NO: 93
  CasX 535

SEQ ID NO: 1050 - protein, 978 aa, Artificial Sequence; identical to SEQ ID NO: 94
  CasX 536 variant

SEQ ID NO: 1051 - protein, 978 aa, Artificial Sequence; identical to SEQ ID NO: 95
  CasX 537 variant

SEQ ID NO: 1052 - protein, 978 aa, Artificial Sequence; identical to SEQ ID NO: 96
  CasX 583 variant

SEQ ID NO: 1053 - protein, 977 aa, Artificial Sequence; identical to SEQ ID NO: 97
  CasX 660 variant

SEQ ID NO: 1054 - protein, 977 aa, Artificial Sequence; identical to SEQ ID NO: 98
  CasX 661

SEQ ID NO: 1055 - protein, 977 aa, Artificial Sequence; identical to SEQ ID NO: 99
  CasX 662 variant

SEQ ID NO: 1056 - protein, 977 aa, Artificial Sequence; identical to SEQ ID NO: 100
  CasX 663 variant

SEQ ID NO: 1057 - protein, 977 aa, Artificial Sequence; identical to SEQ ID NO: 101
  CasX 664 variant

SEQ ID NO: 1058 - protein, 979 aa, Artificial Sequence; identical to SEQ ID NO: 567
  CasX 668 variant

SEQ ID NO: 1059 - protein, 979 aa, Artificial Sequence
  CasX 670 variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1060 - protein, 978 aa, Artificial Sequence; identical to SEQ ID NO: 570
  CasX 672 variant

SEQ ID NO: 1061 - protein, 979 aa, Artificial Sequence; identical to SEQ ID NO: 574
  CasX 676 variant

SEQ ID NO: 1062 - protein, 979 aa, Artificial Sequence; identical to SEQ ID NO: 575
  CasX 677 variant

SEQ ID NO: 1063 - RNA, 130 nt, Artificial Sequence
  sgRNA
gguacuggcgcuuuuaucucauuacuuugagagccaucaccagcgacuaugucguauggguaaagcgcuuauuuaucggagagaaauccgauaaauaagaagcaucaaagggccgagaugucucgcuccg

SEQ ID NO: 1064 - RNA, 107 nt, Artificial Sequence
  sgRNA
gguacuggcgcuuuuaucucauuacuuugagagccaucaccagcgacuaugucguauggguaaagcgcccucuucggagggaagcaucaaagggccgagaugucucg

SEQ ID NO: 1065 - RNA, 120 nt, Artificial Sequence
  sgRNA
gguacuggcgccuuuaucucauuacuuugagagccaucaccagcgacuaugucguauggguaaagcgcuuacggacuucgguccguaagaagcaucaaagggccgagaugucucgcuccg

SEQ ID NO: 1066 - RNA, 109 nt, Artificial Sequence
  sgRNA
acuggcgcuuuuaucugauuacuuugagagccaucaccagcgacuaugucguaguggguaaagcucccucuucggagggagcaucaaagggccgagaugucucgcuccg

SEQ ID NO: 1067 - RNA, 99 nt, Artificial Sequence
  sgRNA
acuggcgcuucuaucugauuacucugagcgccaucaccagcgacuaugucguaguggguaaagccgcuuacggacuucgguccguaagaggcaucagag

SEQ ID NO: 1068 - DNA, 60 bp, Artificial Sequence; identical to SEQ ID NO: 103
  cleavage substrate

SEQ ID NO: 1069 - DNA, 60 bp, Artificial Sequence; identical to SEQ ID NO: 28
  cleavage substrate

SEQ ID NO: 1070 - DNA, 60 bp, Artificial Sequence; identical to SEQ ID NO: 105
  cleavage substrate

SEQ ID NO: 1071 - DNA, 60 bp, Artificial Sequence; identical to SEQ ID NO: 106
  cleavage substrate

SEQ ID NO: 1072 - DNA, 60 bp, Artificial Sequence; identical to SEQ ID NO: 107
  cleavage substrate

SEQ ID NO: 1073 - DNA, 60 bp, Artificial Sequence; identical to SEQ ID NO: 108
  cleavage substrate

SEQ ID NO: 1074 - DNA, 60 bp, Artificial Sequence; identical to SEQ ID NO: 109
  cleavage substrate

SEQ ID NO: 1075 - DNA, 60 bp, Artificial Sequence; identical to SEQ ID NO: 110
  cleavage substrate

SEQ ID NO: 1076 - DNA, 60 bp, Artificial Sequence; identical to SEQ ID NO: 119
  cleavage substrate

SEQ ID NO: 1077 - DNA, 60 bp, Artificial Sequence; identical to SEQ ID NO: 120
  cleavage substrate

SEQ ID NO: 1078 - DNA, 60 bp, Artificial Sequence; identical to SEQ ID NO: 121
  cleavage substrate

SEQ ID NO: 1079 - DNA, 60 bp, Artificial Sequence; identical to SEQ ID NO: 122
  cleavage substrate

SEQ ID NO: 1080 - DNA, 60 bp, Artificial Sequence; identical to SEQ ID NO: 123
  cleavage substrate

SEQ ID NO: 1081 - DNA, 60 bp, Artificial Sequence; identical to SEQ ID NO: 124
  cleavage substrate

SEQ ID NO: 1082 - DNA, 60 bp, Artificial Sequence; identical to SEQ ID NO: 125
  cleavage substrate

SEQ ID NO: 1083 - DNA, 60 bp, Artificial Sequence; identical to SEQ ID NO: 126
  cleavage substrate

SEQ ID NO: 1084 - DNA, 20 bp, Artificial Sequence
  sgRNA spacer
ggccgagatgtctcgctccg

SEQ ID NO: 1085 - DNA, 20 bp, Artificial Sequence
  sgRNA spacer
ggccgagatgtctcgctccg

SEQ ID NO: 1086 - DNA, 18 bp, Artificial Sequence
  sgRNA spacer
ggccgagatgtctcgctc

SEQ ID NO: 1087 - DNA, 19 bp, Artificial Sequence
  sgRNA spacer
ggccgagatgtctcgctcc

SEQ ID NO: 1088 - DNA, 87 bp, Artificial Sequence; identical to SEQ ID NO: 167
  scaffold 174 template fwd primer

SEQ ID NO: 1089 - DNA, 50 bp, Artificial Sequence; identical to SEQ ID NO: 168
  scaffold 174 template rev primer

SEQ ID NO: 1090 - DNA, 36 bp, Artificial Sequence; identical to SEQ ID NO: 191
  scaffold 174 spacer primer

SEQ ID NO: 1091 - DNA, 34 bp, Artificial Sequence; identical to SEQ ID NO: 192
  scaffold 174 spacer primer

SEQ ID NO: 1092 - DNA, 35 bp, Artificial Sequence; identical to SEQ ID NO: 193
  scaffold 174 spacer primer

SEQ ID NO: 1093 - DNA, 36 bp, Artificial Sequence; identical to SEQ ID NO: 170
  sgRNA spacer

SEQ ID NO: 1094 - DNA, 35 bp, Artificial Sequence; identical to SEQ ID NO: 171
  sgRNA spacer

SEQ ID NO: 1095 - DNA, 34 bp, Artificial Sequence; identical to SEQ ID NO: 172
  sgRNA spacer

SEQ ID NO: 1096 - DNA, 36 bp, Artificial Sequence; identical to SEQ ID NO: 173
  sgRNA spacer

SEQ ID NO: 1097 - DNA, 35 bp, Artificial Sequence; identical to SEQ ID NO: 174
  sgRNA spacer

SEQ ID NO: 1098 - DNA, 34 bp, Artificial Sequence; identical to SEQ ID NO: 175
  sgRNA spacer

SEQ ID NO: 1099 - RNA, 20 nt, Artificial Sequence
  sgRNA spacer
caaacaaaugugucacaaag

SEQ ID NO: 1100 - RNA, 19 nt, Artificial Sequence
  sgRNA spacer
caaacaaaugugucacaaa

SEQ ID NO: 1101 - RNA, 18 nt, Artificial Sequence
  sgRNA spacer
caaacaaaugugucacaa

SEQ ID NO: 1102 - RNA, 20 nt, Artificial Sequence
  sgRNA spacer
ggaauaaugcuguuguugaa

SEQ ID NO: 1103 - RNA, 19 nt, Artificial Sequence
  sgRNA spacer
ggaauaaugcuguuguuga

SEQ ID NO: 1104 - RNA, 18 nt, Artificial Sequence
  sgRNA spacer
ggaauaaugcuguuguug

SEQ ID NO: 1105 - RNA, 20 nt, Artificial Sequence
  sgRNA spacer
ggccgagaugucucgcuccg

SEQ ID NO: 1106 - RNA, 20 nt, Artificial Sequence
  sgRNA spacer
cgagacguaauuacgucucg

SEQ ID NO: 1107 - protein, 977 aa, Artificial Sequence
  dCas096 variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1108 - protein, 979 aa, Artificial Sequence
  dCas401 variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1109 - protein, 972 aa, Artificial Sequence
  dCas142 varirant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKE

SEQ ID NO: 1110 - protein, 979 aa, Artificial Sequence
  dCas402 variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1111 - DNA, 1763 bp, Artificial Sequence
  Gag-(-1)-PR
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttttaa

SEQ ID NO: 1112 - DNA, 1902 bp, Artificial Sequence
  Gag-MS2
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1113 - DNA, 1902 bp, Artificial Sequence
  Gag-MS2 N55K
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaagaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1114 - DNA, 3117 bp, Artificial Sequence
  CasX 491 variant with NLS
gccaccatgcccgcggccaaaagggtgaaattggacggagggaagcgcacggccgacggcagtgaattcgagtctccaaagaagaagcgcaaagttggtggcggctccggcggtggatctcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1115 - DNA, 116 bp, Artificial Sequence
  scaffold sequence
actggcgcttttatctgattactttgagagccatcaccagcgactatgtcgtagtgggtaaagctcacatgaggatcacccatgtgagcatcaaagctgcattctagttgtggttt

SEQ ID NO: 1116 - DNA, 175 bp, Artificial Sequence
  scaffold sequence
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggttt

SEQ ID NO: 1117 - DNA, 122 bp, Artificial Sequence
  scaffold sequence
actggcgcttttatctgattactttgagagccatcaccagcgactatgtcgtagtgggtaaagctcacctgaggatcacccaggtgagcatcaaagctgcattctagttgtggttttttttt

SEQ ID NO: 1118 - DNA, 122 bp, Artificial Sequence
  scaffold sequence
actggcgcttttatctgattactttgagagccatcaccagcgactatgtcgtagtgggtaaagctcgcatgaggatcacccatgcgagcatcaaagctgcattctagttgtggttttttttt

SEQ ID NO: 1119 - DNA, 122 bp, Artificial Sequence
  scaffold sequence
actggcgcttttatctgattactttgagagccatcaccagcgactatgtcgtagtgggtaaagctcgcctgaggatcacccaggcgagcatcaaagctgcattctagttgtggttttttttt

SEQ ID NO: 1120 - DNA, 122 bp, Artificial Sequence
  scaffold sequence
actggcgcttttatctgattactttgagagccatcaccagcgactatgtcgtagtgggtaaagctcgcctgagcatcagccaggcgagcatcaaagctgcattctagttgtggttttttttt

SEQ ID NO: 1121 - DNA, 122 bp, Artificial Sequence
  scaffold sequence
actggcgcttttatctgattactttgagagccatcaccagcgactatgtcgtagtgggtaaagctcacatgagcatcagccatgtgagcatcaaagctgcattctagttgtggttttttttt

SEQ ID NO: 1122 - DNA, 122 bp, Artificial Sequence
  scaffold sequence
actggcgcttttatctgattactttgagagccatcaccagcgactatgtcgtagtgggtaaagctcacatgagtatcaaccatgtgagcatcaaagctgcattctagttgtggttttttttt

SEQ ID NO: 1123 - DNA, 122 bp, Artificial Sequence
  scaffold sequence
actggcgcttttatctgattactttgagagccatcaccagcgactatgtcgtagtgggtaaagctcacatgagaatcagccatgtgagcatcaaagctgcattctagttgtggttttttttt

SEQ ID NO: 1124 - DNA, 122 bp, Artificial Sequence
  scaffold sequence
actggcgcttttatctgattactttgagagccatcaccagcgactatgtcgtagtgggtaaagctcccttgaggatcacccatgtgagcatcaaagctgcattctagttgtggttttttttt

SEQ ID NO: 1125 - DNA, 122 bp, Artificial Sequence
  scaffold sequence
actggcgcttttatctgattactttgagagccatcaccagcgactatgtcgtagtgggtaaagctcacttgaggatcacccatgtgagcatcaaagctgcattctagttgtggttttttttt

SEQ ID NO: 1126 - DNA, 122 bp, Artificial Sequence
  scaffold sequence
actggcgcttttatctgattactttgagagccatcaccagcgactatgtcgtagtgggtaaagctcacctgaggatcacccatgtgagcatcaaagctgcattctagttgtggttttttttt

SEQ ID NO: 1127 - DNA, 122 bp, Artificial Sequence
  scaffold sequence
actggcgcttttatctgattactttgagagccatcaccagcgactatgtcgtagtgggtaaagctcacatgaggatcacctatgtgagcatcaaagctgcattctagttgtggttttttttt

SEQ ID NO: 1128 - DNA, 122 bp, Artificial Sequence
  scaffold sequence
actggcgcttttatctgattactttgagagccatcaccagcgactatgtcgtagtgggtaaagctcacattaggatcaccaatgtgagcatcaaagctgcattctagttgtggttttttttt

SEQ ID NO: 1129 - DNA, 122 bp, Artificial Sequence
  scaffold sequence
actggcgcttttatctgattactttgagagccatcaccagcgactatgtcgtagtgggtaaagctcacattaggatcaccgatgtgagcatcaaagctgcattctagttgtggttttttttt

SEQ ID NO: 1130 - DNA, 122 bp, Artificial Sequence
  scaffold sequence
actggcgcttttatctgattactttgagagccatcaccagcgactatgtcgtagtgggtaaagctcacattaggatcacctatgtgagcatcaaagctgcattctagttgtggttttttttt

SEQ ID NO: 1131 - DNA, 122 bp, Artificial Sequence
  scaffold sequence
actggcgcttttatctgattactttgagagccatcaccagcgactatgtcgtagtgggtaaagctcacatgaggattacccatgtgagcatcaaagctgcattctagttgtggttttttttt

SEQ ID NO: 1132 - DNA, 122 bp, Artificial Sequence
  scaffold sequence
actggcgcttttatctgattactttgagagccatcaccagcgactatgtcgtagtgggtaaagctcacatgaggataacccatgtgagcatcaaagctgcattctagttgtggttttttttt

SEQ ID NO: 1133 - DNA, 122 bp, Artificial Sequence
  scaffold sequence
actggcgcttttatctgattactttgagagccatcaccagcgactatgtcgtagtgggtaaagctcacatgaggatgacccatgtgagcatcaaagctgcattctagttgtggttttttttt

SEQ ID NO: 1134 - DNA, 122 bp, Artificial Sequence
  scaffold sequence
actggcgcttttatctgattactttgagagccatcaccagcgactatgtcgtagtgggtaaagctcacatgaggaccacccatgtgagcatcaaagctgcattctagttgtggttttttttt

SEQ ID NO: 1135 - DNA, 122 bp, Artificial Sequence
  scaffold sequence
actggcgcttttatctgattactttgagagccatcaccagcgactatgtcgtagtgggtaaagctcagatgaggatcacccatgggagcatcaaagctgcattctagttgtggttttttttt

SEQ ID NO: 1136 - DNA, 122 bp, Artificial Sequence
  scaffold sequence
actggcgcttttatctgattactttgagagccatcaccagcgactatgtcgtagtgggtaaagctcacatggggatcacccatgtgagcatcaaagctgcattctagttgtggttttttttt

SEQ ID NO: 1137 - RNA, 19 nt, Artificial Sequence
  MS2 hairpin sequence
acaugaggaucacccaugu

SEQ ID NO: 1138 - RNA, 19 nt, Artificial Sequence
  MS2 hairpin sequence
accugaggaucacccaggu

SEQ ID NO: 1139 - RNA, 19 nt, Artificial Sequence
  MS2 hairpin sequence
gcaugaggaucacccaugc

SEQ ID NO: 1140 - RNA, 19 nt, Artificial Sequence
  MS2 hairpin sequence
gccugaggaucacccaggc

SEQ ID NO: 1141 - RNA, 19 nt, Artificial Sequence
  MS2 hairpin sequence
gccugagcaucagccaggc

SEQ ID NO: 1142 - RNA, 19 nt, Artificial Sequence
  MS2 hairpin sequence
acaugagcaucagccaugu

SEQ ID NO: 1143 - RNA, 19 nt, Artificial Sequence
  MS2 hairpin sequence
acuugaggaucacccaugu

SEQ ID NO: 1144 - RNA, 19 nt, Artificial Sequence
  MS2 hairpin sequence
acauuaggaucaccaaugu

SEQ ID NO: 1145 - RNA, 19 nt, Artificial Sequence
  MS2 hairpin sequence
acaugaggaccacccaugu

SEQ ID NO: 1146 - RNA, 20 nt, Artificial Sequence
  spacer sequence
cugcauucuaguugugguuu

SEQ ID NO: 1147 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNARRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1148 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQVDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1149 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEGEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1150 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLEHLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1151 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQICAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1152 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1153 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFGGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1154 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKLVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1155 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGQFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1156 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVSWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1157 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLREKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1158 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTTYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1159 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEANRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1160 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEELRRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1161 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDERCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1162 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1163 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRQKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1164 - protein, 978 aa, Artificial Sequence
  CasX variant
QEIKRLNKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1165 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLDAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1166 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1167 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYVGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1168 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINGEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1169 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRFASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1170 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWYTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1171 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVPCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1172 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQTIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1173 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPCQEKFVCLNCGFETHADEQAALNIARSWLFLRSQEYKKYQTNKTTGNTDKRAFVETWQSFYRKKLKEVWKPAV

SEQ ID NO: 1174 - protein, 979 aa, Artificial Sequence
  CasX variant
QEIKRINKIRRRLVKDSNTKKAGKTGPMKTLLVRVMTPDLRERLENLPRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1175 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEGLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1176 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1177 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTISKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1178 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTKSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1179 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKQLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1180 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYYSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1181 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAKYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1182 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLASKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1183 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1184 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1185 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTWITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1186 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKHTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1187 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKPCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1188 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1189 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1190 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLFAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1191 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKNTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1192 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGPTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1193 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTWLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1194 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTMSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1195 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1196 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSVNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1197 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTPKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1198 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWPLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1199 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCMSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1200 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLARYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1201 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYFSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1202 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1203 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSQTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1204 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYNGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1205 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLHSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1206 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKVYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1207 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLQAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1208 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGPLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1209 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKRTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1210 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCWGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1211 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLANYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1212 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNSGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1213 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLSQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1214 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYRLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1215 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKRAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1216 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKDAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1217 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1218 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYMSGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1219 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAIYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1220 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDVRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1221 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDREKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1222 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEMFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1223 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKQNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1224 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVIMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1225 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVNDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1226 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSGKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1227 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1228 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1229 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCEFETHADEQAALNIARSWLFLRSQEYKKYQTNKTTGNTDKRAFVETWQSFYRKKLKEVWKPAV

SEQ ID NO: 1230 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTSTGNTDKRAFVETWQSFYRKKLKEVWKPAV

SEQ ID NO: 1231 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGKNTDKRAFVETWQSFYRKKLKEVWKPAV

SEQ ID NO: 1232 - protein, 977 aa, Artificial Sequence; identical to SEQ ID NO: 1107
  dCasX variant

SEQ ID NO: 1233 - protein, 979 aa, Artificial Sequence; identical to SEQ ID NO: 1108
  dCasX variant

SEQ ID NO: 1234 - protein, 972 aa, Artificial Sequence; identical to SEQ ID NO: 1109
  dCasX variant

SEQ ID NO: 1235 - protein, 979 aa, Artificial Sequence; identical to SEQ ID NO: 1110
  dCasX variant

SEQ ID NO: 1236 - protein, 150 aa, Artificial Sequence
  nuclear localization signal
TLESPAAKRVKLDGGSPAAKRVKLDGGSPAAKRVKLDGGSPAAKRVKLDGGSPAAKRVKLDGGSPAAKRVKLDTLESKRPAATKKAGQAKKKKGGSKRPAATKKAGQAKKKKGGSKRPAATKKAGQAKKKKGGSKRPAATKKAGQAKKKK

SEQ ID NO: 1237 - protein, 135 aa, Artificial Sequence
  nuclear localization signal
TLESKRPAATKKAGQAKKKKTLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKK

SEQ ID NO: 1238 - protein, 80 aa, Artificial Sequence
  nuclear localization signal
TLESKRPAATKKAGQAKKKKGGSKRPAATKKAGQAKKKKTLESPKKKRKVGGSPKKKRKVGGSPKKKRKVGGSPKKKRKV

SEQ ID NO: 1239 - protein, 54 aa, Artificial Sequence
  nuclear localization signal
TLEGGSPKKKRKVTLESPKKKRKVGGSPKKKRKVGGSPKKKRKVGGSPKKKRKV

SEQ ID NO: 1240 - protein, 62 aa, Artificial Sequence
  nuclear localization signal
TLEGGSPKKKRKVTLESPAAKRVKLDGGSPAAKRVKLDGGSPAAKRVKLDGGSPAAKRVKLD

SEQ ID NO: 1241 - protein, 86 aa, Artificial Sequence
  nuclear localization signal
TLEGGSPKKKRKVTLESPAAKRVKLDGGSPAAKRVKLDGGSPAAKRVKLDGGSPAAKRVKLDGGSPAAKRVKLDGGSPAAKRVKLD

SEQ ID NO: 1242 - protein, 33 aa, Artificial Sequence
  nuclear localization signal
TLEGGSPKKKRKVTLESKRPAATKKAGQAKKKK

SEQ ID NO: 1243 - protein, 52 aa, Artificial Sequence
  nuclear localization signal
TLEGGSPKKKRKVTLESKRPAATKKAGQAKKKKGGSKRPAATKKAGQAKKKK

SEQ ID NO: 1244 - protein, 26 aa, Artificial Sequence
  nuclear localization signal
TLEGGSPKKKRKVTLEGGSPKKKRKV

SEQ ID NO: 1245 - protein, 47 aa, Artificial Sequence
  nuclear localization signal
TLEVGPKRTADSQHSTPPKTKRKVEFEPKKKRKVTLEGGSPKKKRKV

SEQ ID NO: 1246 - protein, 53 aa, Artificial Sequence
  nuclear localization signal
TLEVGGGSGGGSKRTADSQHSTPPKTKRKVEFEPKKKRKVTLEGGSPKKKRKV

SEQ ID NO: 1247 - protein, 62 aa, Artificial Sequence
  nuclear localization signal
TLEVAEAAAKEAAAKEAAAKAKRTADSQHSTPPKTKRKVEFEPKKKRKVTLEGGSPKKKRKV

SEQ ID NO: 1248 - protein, 57 aa, Artificial Sequence
  nuclear localization signal
TLEVGPPKKKRKVGGSKRTADSQHSTPPKTKRKVEFEPKKKRKVTLEGGSPKKKRKV

SEQ ID NO: 1249 - protein, 45 aa, Artificial Sequence
  nuclear localization signal
TLEVGPAEAAAKEAAAKEAAAKAPAAKRVKLDTLEGGSPKKKRKV

SEQ ID NO: 1250 - protein, 61 aa, Artificial Sequence
  nuclear localization signal
TLEVGPGGGSGGGSGGGSPAAKRVKLDTLEVGPKRTADSQHSTPPKTKRKVEFEPKKKRKV

SEQ ID NO: 1251 - protein, 65 aa, Artificial Sequence
  nuclear localization signal
TLEVGPPKKKRKVPPPPAAKRVKLDTLEVGGGSGGGSKRTADSQHSTPPKTKRKVEFEPKKKRKV

SEQ ID NO: 1252 - protein, 64 aa, Artificial Sequence
  nuclear localization signal
TLEVGPPAAKRVKLDTLEVAEAAAKEAAAKEAAAKAKRTADSQHSTPPKTKRKVEFEPKKKRKV

SEQ ID NO: 1253 - protein, 78 aa, Artificial Sequence
  nuclear localization signal
TLEVGPKRTADSQHSTPPKTKRKVEFEPKKKRKVTLEVGPPKKKRKVGGSKRTADSQHSTPPKTKRKVEFEPKKKRKV

SEQ ID NO: 1254 - protein, 72 aa, Artificial Sequence
  nuclear localization signal
TLEVGGGSGGGSKRTADSQHSTPPKTKRKVEFEPKKKRKVTLEVGPAEAAAKEAAAKEAAAKAPAAKRVKLD

SEQ ID NO: 1255 - protein, 45 aa, Artificial Sequence
  nuclear localization signal
GSKRPAATKKAGQAKKKKTLEVGPGGGSGGGSGGGSPAAKRVKLD

SEQ ID NO: 1256 - protein, 43 aa, Artificial Sequence
  nuclear localization signal
GSKRPAATKKAGQAKKKKTLEVGPPKKKRKVPPPPAAKRVKLD

SEQ ID NO: 1257 - protein, 33 aa, Artificial Sequence
  nuclear localization signal
GSKRPAATKKAGQAKKKKTLEVGPPAAKRVKLD

SEQ ID NO: 1258 - protein, 43 aa, Artificial Sequence
  nuclear localization signal
GSPKKKRKVTLEVGPKRTADSQHSTPPKTKRKVEFEPKKKRKV

SEQ ID NO: 1259 - protein, 58 aa, Artificial Sequence
  nuclear localization signal
GSKRPAATKKAGQAKKKKTLEVGGGSGGGSKRTADSQHSTPPKTKRKVEFEPKKKRKV

SEQ ID NO: 1260 - protein, 36 aa, Artificial Sequence
  nuclear localization signal
GSKRPAATKKAGQAKKKKGSKRPAATKKAGQAKKKK

SEQ ID NO: 1261 - protein, 36 aa, Artificial Sequence; identical to SEQ ID NO: 1260
  nuclear localization signal

SEQ ID NO: 1262 - protein, 36 aa, Artificial Sequence; identical to SEQ ID NO: 1260
  nuclear localization signal

SEQ ID NO: 1263 - protein, 18 aa, Artificial Sequence
  nuclear localization signal
GSPKKKRKVGSPKKKRKV

SEQ ID NO: 1264 - protein, 54 aa, Artificial Sequence
  nuclear localization signal
GGGSGGGSKRTADSQHSTPPKTKRKVEFEPKKKRKVGSKRPAATKKAGQAKKKK

SEQ ID NO: 1265 - protein, 58 aa, Artificial Sequence
  nuclear localization signal
GPPKKKRKVGGSKRTADSQHSTPPKTKRKVEFEPKKKRKVGSKRPAATKKAGQAKKKK

SEQ ID NO: 1266 - protein, 44 aa, Artificial Sequence
  nuclear localization signal
TGGGPGGGAAAGSGSPKKKRKVGSGSGSKRPAATKKAGQAKKKK

SEQ ID NO: 1267 - protein, 48 aa, Artificial Sequence
  nuclear localization signal
GPKRTADSQHSTPPKTKRKVEFEPKKKRKVGSKRPAATKKAGQAKKKK

SEQ ID NO: 1268 - protein, 54 aa, Artificial Sequence
  nuclear localization signal
AEAAAKEAAAKEAAAKAKRTADSQHSTPPKTKRKVEFEPKKKRKVGSPKKKRKV

SEQ ID NO: 1269 - protein, 57 aa, Artificial Sequence
  nuclear localization signal
GPPKKKRKVPPPPAAKRVKLDGGGSGGGSKRTADSQHSTPPKTKRKVEFEPKKKRKV

SEQ ID NO: 1270 - protein, 111 aa, Artificial Sequence
  nuclear localization signal
GSPAAKRVKLDGGSPAAKRVKLDGGSPAAKRVKLDGGSPAAKRVKLDGGSPAAKRVKLDGGSPAAKRVKLDGPPKKKRKVGGSKRTADSQHSTPPKTKRKVEFEPKKKRKV

SEQ ID NO: 1271 - protein, 67 aa, Artificial Sequence
  nuclear localization signal
GSPAAKRVKLGGSPAAKRVKLGGSPKKKRKVGGSPKKKRKVTGGGPGGGAAAGSGSPKKKRKVGSGS

SEQ ID NO: 1272 - protein, 67 aa, Artificial Sequence
  nuclear localization signal
GSKRPAATKKAGQAKKKKGGSKRPAATKKAGQAKKKKGPKRTADSQHSTPPKTKRKVEFEPKKKRKV

SEQ ID NO: 1273 - protein, 82 aa, Artificial Sequence
  nuclear localization signal
GSKRPAATKKAGQAKKKKGGSKRPAATKKAGQAKKKKAEAAAKEAAAKEAAAKAKRTADSQHSTPPKTKRKVEFEPKKKRKV

SEQ ID NO: 1274 - protein, 73 aa, Artificial Sequence
  nuclear localization signal
TLESKRPAATKKAGQAKKKKGGSKRPAATKKAGQAKKKKAPGEYPYDVPDYATSPKKKRKVALEYPYDVPDYA

SEQ ID NO: 1275 - protein, 98 aa, Artificial Sequence
  nuclear localization signal
TLESKRPAATKKAGQAKKKKGGSKRPAATKKAGQAKKKKGGSKRPAATKKAGQAKKKKGGSKRPAATKKAGQAKKKKTSPKKKRKVALEYPYDVPDYA

SEQ ID NO: 1276 - protein, 136 aa, Artificial Sequence
  nuclear localization signal
TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKTSPKKKRKVALEYPYDVPDYA

SEQ ID NO: 1277 - protein, 74 aa, Artificial Sequence
  nuclear localization signal
TLESPKKKRKVGGSPKKKRKVGGSPKKKRKVGGSPKKKRKVTLESKRPAATKKAGQAKKKKAPGEYPYDVPDYA

SEQ ID NO: 1278 - protein, 68 aa, Artificial Sequence
  nuclear localization signal
TLESPKKKRKVGGSPKKKRKVGGSPKKKRKVGGSPKKKRKVGSKRPAATKKAGQAKKKKYPYDVPDYA

SEQ ID NO: 1279 - protein, 101 aa, Artificial Sequence
  nuclear localization signal
TLESPAAKRVKLDGGSPAAKRVKLDGGSPAAKRVKLDGGSPAAKRVKLDTLESKRPAATKKAGQAKKKKGGSKRPAATKKAGQAKKKKAPGEYPYDVPDYA

SEQ ID NO: 1280 - RNA, 31 nt, Artificial Sequence
  stem loop sequence
ugggcgcagcgucaaugacgcugacgguaca

SEQ ID NO: 1281 - RNA, 66 nt, Artificial Sequence
  stem loop sequence
gcacuaugggcgcagcgucaaugacgcugacgguacaggccagacaauuauugucugguauagugc

SEQ ID NO: 1282 - RNA, 167 nt, Artificial Sequence
  stem loop sequence
caggaagcacuaugggcgcagcgucaaugacgcugacgguacaggccagacaauuauugucugguauagugcagcagcagaacaauuugcugagggcuauugaggcgcaacagcaucuguugcaacucacagucuggggcaucaagcagcuccaggcaagaauccug

SEQ ID NO: 1283 - RNA, 234 nt, Artificial Sequence
  stem loop sequence
aggagcuuuguuccuuggguucuugggagcagcaggaagcacuaugggcgcagcgucaaugacgcugacgguacaggccagacaauuauugucugguauagugcagcagcagaacaauuugcugagggcuauugaggcgcaacagcaucuguugcaacucacagucuggggcaucaagcagcuccaggcaagaauccuggcuguggaaagauaccuaaaggaucaacagcuccu

SEQ ID NO: 1284 - RNA, 15 nt, Artificial Sequence
  stem loop sequence
gcugacgguacaggc

SEQ ID NO: 1285 - RNA, 29 nt, Artificial Sequence
  extended stem loop
gcgcuuacggacuucgguccguaacaagc

SEQ ID NO: 1286 - RNA, 29 nt, Artificial Sequence
  extended stem loop
gccgcuuacggacuucggccguaagaggc

SEQ ID NO: 1287 - RNA, 33 nt, Artificial Sequence
  pseudoknot
acuggcgcuucuaucugauuacucugagcgcca

SEQ ID NO: 1288 - RNA, 66 nt, Artificial Sequence
  scaffold and extended stems
ucaccagcgacuaugucguaguggguaaagccgcuuacggaguucgguccguaagaggcaucagag

SEQ ID NO: 1289 - RNA, 18 nt, Artificial Sequence
  MS2 sequence
acaugaggaucacccugu

SEQ ID NO: 1290-2100 - skipped (811 entries)

SEQ ID NO: 2101 - RNA, 108 nt, Artificial Sequence
  scaffold variant
uacuggcgcuuuuaucucauuacuuugagagccaucaccagcgacuaugucguauggguaaagcgcaggugggacgaccucucggucguccuaucugaagcaucaaag

SEQ ID NO: 2102 - RNA, 99 nt, Artificial Sequence
  scaffold variant
uacuggcgcuuuuaucucauuacuuugagagccaucaccagcgacuaugucguauggguaaagcgcugcucgacgcguccucgagcagaagcaucaaag

SEQ ID NO: 2103 - RNA, 97 nt, Artificial Sequence
  scaffold variant
uacuggcgcuuuuaucucauuacuuugagagccaucaccagcgacuaugucguauggguaaagcgcugcucgcuccguucgagcagaagcaucaaag

SEQ ID NO: 2104 - RNA, 91 nt, Artificial Sequence
  scaffold variant
guacuggcgcuuuuaucucauuacuuugagagccaucaccagcgacuaugucguauggguaaagcgcccucuucggagggaagcaucaaag

SEQ ID NO: 2105 - RNA, 99 nt, Artificial Sequence
  scaffold variant
uacuggcgcuuuuaucucauuacuuugagagccaucaccagcgacuaugucguauggguaaagcgcaggaguuucuauggaaacccugaagcaucaaag

SEQ ID NO: 2106 - RNA, 99 nt, Artificial Sequence
  scaffold variant
guacuggcgccuuuaucucauuacuuugagagccaucaccagcgacuaugucguauggguaaagcgcuuacggacuucgguccguaagaagcaucaaag

SEQ ID NO: 2107 - RNA, 90 nt, Artificial Sequence
  scaffold variant
uacuggcgcuuuuaucucauuacuuugagagccaucaccagcgacuaugucguauggguaaagcgcugcgcuugcgcagaagcaucaaag

SEQ ID NO: 2108 - RNA, 108 nt, Artificial Sequence
  scaffold variant
uacuggcgcuuuuaucugauuacuuugagagccaucaccagcgacuaugucguauggguaaagcgcuuauuuaucggagagaaauccgauaaauaagaagcaucaaag

SEQ ID NO: 2109 - RNA, 108 nt, Artificial Sequence
  scaffold variant
uacuggcgcuuuuaucgcauuacuuugagagccaucaccagcgacuaugucguauggguaaagcgcuuauuuaucggagagaaauccgauaaauaagaagcaucaaag

SEQ ID NO: 2110 - RNA, 110 nt, Artificial Sequence
  scaffold variant
uacuggcgcuuuuaucucauuacuuugagagccaucaccagcgacuaugucguauggguaaagcgcuuauuuaucggagacuucgguccgauaaauaagaagcaucaaag

SEQ ID NO: 2111 - RNA, 97 nt, Artificial Sequence
  scaffold variant
uacuggcgcuuuuaucucauuacuuugagagccaucaccagcgacuaugucguauggguaaagcgcacaugaggauuacccaugugaagcaucaaag

SEQ ID NO: 2112 - RNA, 106 nt, Artificial Sequence
  scaffold variant
gcuggcgcuuuuaucucauuacuuugagagccaucaccagcgacuaugucguauggguaaagcgcuuauuuaucgugagaaauccgauaaauaagaagcaucaaag

SEQ ID NO: 2113 - RNA, 96 nt, Artificial Sequence
  scaffold variant
uacuggcgcuuuuaucucauuacuuugagagccaucaccagcgacuaugucguauggguaaagcgcugcaugucuaagacagcagaagcaucaaag

SEQ ID NO: 2114 - RNA, 90 nt, Artificial Sequence
  scaffold variant
uacuggcgcuuuuaucucauuacuuugagagccaucaccagcgacuaugucguauggguaaagcgcagggcuucggccgaagcaucaaag

SEQ ID NO: 2115 - RNA, 98 nt, Artificial Sequence
  scaffold variant
uacuggcgcuuuuaucucauuacuuugagagccaucaccagcgacuaugucguauggguaaagcgcaauccauugcacuccggauugaagcaucaaag

SEQ ID NO: 2116 - RNA, 108 nt, Artificial Sequence
  scaffold variant
uacuggcgcuuuucucgcauuacuuugagagccaucaccagcgacuaugucguauggguaaagcgcuuauuuaucggagagaaauccgauaaauaagaagcaucaaag

SEQ ID NO: 2117 - RNA, 108 nt, Artificial Sequence
  scaffold variant
uacuggcgcuuuuaucucauuacuuugagagccaucaccagcgacuaugucguauggguaaagcgcuuauuuaucggacuucgguccgauaaauaagaagcaucaaag

SEQ ID NO: 2118 - RNA, 100 nt, Artificial Sequence
  scaffold variant
uacuggcgcuuuuaucucauuacuuugagagccaucaccagcgacuaugucguauggguaaagcgcugcucguuugcggcuacgagcagaagcaucaaag

SEQ ID NO: 2119 - RNA, 100 nt, Artificial Sequence
  scaffold variant
uacuggcgcuuuuaucucauuacuuugagagccaucaccagcgacuaugucguauggguaaagcgcuuauuuaucgagagauaaauaagaagcaucaaag

SEQ ID NO: 2120 - RNA, 107 nt, Artificial Sequence
  scaffold variant
uacggcgcuuuuaucucauuacuuugagagccaucaccagcgacuaugucguauggguaaagcgcuuauuuaucggagagaaauccgauaaauaagaagcaucaaag

SEQ ID NO: 2121 - RNA, 99 nt, Artificial Sequence
  scaffold variant
uacuggcgccuuuuaucucauuacuuugagagccaucaccagcgacuaugucguauggguaaagcgcuuacggacuucgguccguaagaagcaucaaag

SEQ ID NO: 2122 - RNA, 108 nt, Artificial Sequence
  scaffold variant
uacuggcgcuuuuaucucauuacuuugagagccaucaccagcgacuaugucguaucgguaaagcgcuuauuuaucggagagaaauccgauaaauaagaagcaucaaag

SEQ ID NO: 2123 - RNA, 108 nt, Artificial Sequence
  scaffold variant
uacuggcgccuuuaucucauuacuuugagagccaucaccagcgacuaugucguauggguaaagcgcuuauuuaucggacuucgguccgauaaauaagaagcaucaaag

SEQ ID NO: 2124 - RNA, 105 nt, Artificial Sequence
  scaffold variant
uacuggcgcuuuuaucucauuacuuugagagccaucaccagcgacuaugucguauggguaaagcgcuuauuuaucgagaaauccgauaaauaagaagcaucaaag

SEQ ID NO: 2125 - RNA, 103 nt, Artificial Sequence
  scaffold variant
gcgcuuuuaucucauuacuuugagagccaucaccagcgacuaugucguauggguaaagcgcuuauuuaucggagagaaauccgauaaauaagaagcaucaaag

SEQ ID NO: 2126 - RNA, 103 nt, Artificial Sequence
  scaffold variant
uacuggcgcuuuuaucucauuacuuugagagccaucaccagcgacuaugucguauggguaaagcgcuuauuuaucggagagagauaaauaagaagcaucaaag

SEQ ID NO: 2127 - RNA, 108 nt, Artificial Sequence
  scaffold variant
uacuggcgcuuuuaucucauuacuuuggagagccaucaccagcgacuaugucguauggguaaagcgcuuauuuaucggagaguauccgauaaauaagaagcaucaaag

SEQ ID NO: 2128 - RNA, 109 nt, Artificial Sequence
  scaffold variant
uacuggcgcuuuuaucucauuacuuugagagccaucaccagcgacuauguucguauggguaaagcgcuuauuuaucggagagaaauccgauaaauaagaagcaucaaag

SEQ ID NO: 2129 - RNA, 105 nt, Artificial Sequence
  scaffold variant
agcgcuuuuaucucauuacuuugagagccaucaccagcgacuaugucguauggguaaagcgcuuauuuaucggagagaaaugccgauaaauaagaagcaucaaag

SEQ ID NO: 2130 - RNA, 109 nt, Artificial Sequence
  scaffold variant
uacuggcgcuuuuaucucauuacuuugagagccaucaccagcgacuaugucguauggguaaagcgcuuauuuaucggagagaaauccgauaaaauaagaagcaucaaag

SEQ ID NO: 2131 - RNA, 109 nt, Artificial Sequence
  scaffold variant
uacuggcgcuuuuaucucauuacuuugagagccaucaccagcgacuaugucguauggguaaagcgcuuauuguaucggagagaaauccgauaaauaagaagcaucaaag

SEQ ID NO: 2132 - RNA, 102 nt, Artificial Sequence
  scaffold variant
gcgcuuuuaucucauuacuuugagagccaucaccagcgacuaugucguauggguaaagcgcuuauuuaucggacuucgguccgauaaauaagcgcaucaaag

SEQ ID NO: 2133 - RNA, 108 nt, Artificial Sequence
  scaffold variant
uacuggcgcuuuucucucauuacuuugagagccaucaccagcgacuaugucguauggguaaagcgcuuauuuaucggagagaaauccgauaaauaagaagcaucaaag

SEQ ID NO: 2134 - RNA, 106 nt, Artificial Sequence
  scaffold variant
guggcgcuuuuaucucauuacuuugagagccaucaccagcgacuaugucguauggguaaagcgcuuauuuaucggagagaaauccgauaaauaagaagcaucaaag

SEQ ID NO: 2135 - RNA, 110 nt, Artificial Sequence
  scaffold variant
uacuggcgcuuuuaucucauuacuuugagagccaucaccagcgaccuuaugucguauggguaaagcgcuuauuuaucggagagaaauccgauaaauaagaagcaucaaag

SEQ ID NO: 2136 - RNA, 107 nt, Artificial Sequence
  scaffold variant
gauggcgcuuuuaucucauuacuuugagagccaucaccagcgacuaugucguauggguaaagcgcuuauuuaucggacuucgguccgauaaauaagaagcaucaaag

SEQ ID NO: 2137 - RNA, 106 nt, Artificial Sequence
  scaffold variant
uacuggcgcuuuuaucucauuacuuugagagccaucaccagcgacuaugucguauggguaaagcgcuuauuuaucggagagaaauccgauaaaagaagcaucaaag

SEQ ID NO: 2138 - RNA, 109 nt, Artificial Sequence
  scaffold variant
uacuggcgcuuuuaucucauuacuuugagagccaucaccagcgaucuaugucguauggguaaagcgcuuauuuaucggagagaaauccgauaaauaagaagcaucaaag

SEQ ID NO: 2139 - RNA, 106 nt, Artificial Sequence
  scaffold variant
uacuggcgcuuuuaucucauuacuuugagagccaucaccagcgacuaugucguauggguaaaggcuuauuuaucggagagaaauccgauaaaaagaagcaucaaag

SEQ ID NO: 2140 - RNA, 107 nt, Artificial Sequence
  scaffold variant
uacuggcgcuuuuaucucauuacuuugagagccaucaccagcgacuaugucguauggguaaagcgcuuauuuaucggagagaaauccgauaaaaagaagcaucaaag

SEQ ID NO: 2141 - RNA, 107 nt, Artificial Sequence
  scaffold variant
uacuggcgcuuuaucucauuacuuugagagccaucaccagcgacuaugucguauggguaaagcgcuuauuuaucggacuucgguccgauaaauaagaagcaucaaag

SEQ ID NO: 2142 - RNA, 98 nt, Artificial Sequence
  scaffold variant
cggcgcuuuucucgcauuacuuugagagccaucaccagcgacuaugucguauggguaaagcgcuuauuguaucgagagauaaauaagaagcaucaaag

SEQ ID NO: 2143 - RNA, 107 nt, Artificial Sequence
  scaffold variant
cacuggcgcuuuuaucucauuacuuugagagccaucaccagcgacuaugucguauggguaaagcgcuuauuuucggagagaaauccgauaaauaagaagcaucaaag

SEQ ID NO: 2144 - RNA, 106 nt, Artificial Sequence
  scaffold variant
uacuggcgcuuuaucucauuacuuugagagccaucaccagcgacuucggucguauggguaaagcgcuuauguaucggcuucggccgauacauaagaagcaucaaag

SEQ ID NO: 2145 - RNA, 107 nt, Artificial Sequence
  scaffold variant
uacuggcgcuuuuaucucauuacuuugagagccaucaccagcgacuucggucguauggguaaagcgcuuauguaucggcuucggccgauacauaagaagcaucaaag

SEQ ID NO: 2146 - RNA, 109 nt, Artificial Sequence
  scaffold variant
uacuggcgcuuuuaucucauuacuuugagagccaucaccagcgacuaugucguaugggugaaagcgcuuauuuaucggagagaaauccgauaaauaagaagcaucaaag

SEQ ID NO: 2147 - RNA, 64 nt, Artificial Sequence
  scaffold variant
uacuggcgcuuuuaucucauuacuuugagagccaucaccagcgacuucggucguauggguaaag

SEQ ID NO: 2148 - RNA, 62 nt, Artificial Sequence
  scaffold variant
gaugggcuuuuaucucauuacuuugagagccaucaccagcgacuucggucguauggguaaag

SEQ ID NO: 2149 - RNA, 105 nt, Artificial Sequence
  scaffold variant
gaugggcuuuuaucucauuacuuugagagccaucaccagcgacuucggucguauggguaaagcgcuuauuuaucggcuucggccgauaaauaagaagcaucaaag

SEQ ID NO: 2150 - RNA, 156 nt, Artificial Sequence
  scaffold variant
uacuggcgcuuuuaucucauuacuuugagagccaucaccagcgacuaugucguauggguaaagcgcuacacugggaucgcugaauuagagaucggcguccuuucauucuauauacuuuggaguuuuaaaaugucucuaaguacagaagcaucaaag

SEQ ID NO: 2151 - RNA, 103 nt, Artificial Sequence
  scaffold variant
ggcgcuuuuaucucauuacuuugagagccaucaccagcgacuucggucguauggguaaagcgcuuauuuaucggcuucggccgauaaauaagaagcaucaaag

SEQ ID NO: 2152 - RNA, 106 nt, Artificial Sequence
  scaffold variant
gcuggcgcuuuuaucucauuacuuugagagccaucaccagcgacuucggucguauggguaaagcgcuuauuuaucggcuucggccgauaaauaagaagcaucaaag

SEQ ID NO: 2153 - RNA, 109 nt, Artificial Sequence
  scaffold variant
uacuggcgcuuuuaucucauuacuuugagagccaucaccagcgacuucggucguauggguaaagcgcuuauuuaucggagagaaauccgauaaauaagaagcaucaaag

SEQ ID NO: 2154 - RNA, 112 nt, Artificial Sequence
  scaffold variant
uacuggcgcuuuuaucucauuacuuugagagccaugcuccaccagcgacuaugucguauggguaaagcgcuuauuuaucggagagaaauccgauaaauaagaagcaucaaag

SEQ ID NO: 2155 - RNA, 97 nt, Artificial Sequence
  scaffold variant
uacuggcgcuuuuaucucauuacuuugagagccaucaccagcgacuaugucguauggguaaagcgggguuaggguuaggguuagggaagcaucaaag

SEQ ID NO: 2156 - RNA, 96 nt, Artificial Sequence
  scaffold variant
uacuggcgcuuuuaucucauuacuuugagagccaucaccagcgacuaugucguauggguaaagcggagggagggagggagagggaaagcaucaaag

SEQ ID NO: 2157 - RNA, 101 nt, Artificial Sequence
  scaffold variant
uacuggcgcuuuuaucucauuacuuugagagccaucaccagcgacuaugucguauggguaaagcguuggguuaggguuaggguuagggaaaagcaucaaag

SEQ ID NO: 2158 - RNA, 91 nt, Artificial Sequence
  scaffold variant
uacuggcgcuuuuaucucauuacuuugagagccaucaccagcgacuaugucguauggguaaagcgcagggcuucggccggaagcaucaaag

SEQ ID NO: 2159 - RNA, 103 nt, Artificial Sequence
  scaffold variant
uacuggcgcuuuuaucucauuacuuugagagccaucaccagcgacuaugucguauggguaaagcgccugcucaguacgagaggaaccgcaggaagcaucaaag

SEQ ID NO: 2160 - RNA, 90 nt, Artificial Sequence
  scaffold variant
uacuggcgcuuuuaucugauuacuuugagagccaucaccagcgacuaugucguauggguaaagcgcccucuucggagggaagcaucaaag

SEQ ID NO: 2161 - RNA, 98 nt, Artificial Sequence
  scaffold variant
uacuggcgccuuuaucugauuacuuugagagccaucaccagcgacuaugucguauggguaaagcgcuuacggacuucgguccguaagaagcaucaaag

SEQ ID NO: 2162 - RNA, 98 nt, Artificial Sequence
  scaffold variant
uacuggcgcuuuuaucugauuacuuugagagccaucaccagcgacuaugucguauggguaaagcgcggacgaccucucggucguccgaagcaucaaag

SEQ ID NO: 2163 - RNA, 108 nt, Artificial Sequence
  scaffold variant
uacuggcgcuuuuaucugauuacuuugagagccaucaccagcgacuaugucguauggguaaagcgcaggugggacgaccucucggucguccuaucugaagcaucaaag

SEQ ID NO: 2164 - RNA, 99 nt, Artificial Sequence
  scaffold variant
uacuggcgccuuuaucugcauuacuuugagagccaucaccagcgacuaugucguauggguaaagcgcuuacggacuucgguccguaagaagcaucaaag

SEQ ID NO: 2165 - RNA, 97 nt, Artificial Sequence
  scaffold variant
gcuggcgcuuuuaucugauuacuuugagagccaucaccagcgacuaugucguauggguaaagcgcuuacggacuucgguccguaagaagcaucaaag

SEQ ID NO: 2166 - RNA, 108 nt, Artificial Sequence
  scaffold variant
uacuggcgccuuuaucugauuacuuugagagccaucaccagcgacuaugucguauggguaaagcgcaggugggacgaccucucggucguccuaucugaagcaucaaag

SEQ ID NO: 2167 - RNA, 98 nt, Artificial Sequence
  scaffold variant
uacuggcgccuuuaucugauuacuuugagagccaucaccagcgacuaugucguauggguaaagcgcggacgaccucucggucguccgaagcaucaaag

SEQ ID NO: 2168 - RNA, 90 nt, Artificial Sequence
  scaffold variant
uacuggcgccuuuaucucauuacuuugagagccaucaccagcgacuaugucguauggguaaagcgcccucuucggagggaagcaucaaag

SEQ ID NO: 2169 - RNA, 98 nt, Artificial Sequence
  scaffold variant
uacuggcgcuuuuaucucauuacuuugagagccaucaccagcgacuaugucguauggguaaagcgcuuacggacuucgguccguaagaagcaucaaag

SEQ ID NO: 2170 - RNA, 99 nt, Artificial Sequence
  scaffold variant
uacuggcgccuuuaucaucauuacuuugagagccaucaccagcgacuaugucguauggguaaagcgcuuacggacuucgguccguaagaagcaucaaag

SEQ ID NO: 2171 - RNA, 194 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagggccggcauggucccagccuccucgcuggcgccggcugggcaacauuccgaggggaccguccccucgguaauggcgaaugggaccc

SEQ ID NO: 2172 - RNA, 108 nt, Artificial Sequence
  scaffold variant
uacuggcgccuuuaucucauuacuuugagagccaucaccagcgacuaugucguauggguaaagcgcaggugggacgaccucucggucguccuaucugaagcaucaaag

SEQ ID NO: 2173 - RNA, 106 nt, Artificial Sequence
  scaffold variant
uacuggcgcuuuuaucucauuacuuugagagccaucaccagcgacuaugucguauggguaaagcgcuuauuuaucggagaaauccgauaaauaagaagcaucaaag

SEQ ID NO: 2174 - RNA, 98 nt, Artificial Sequence
  scaffold variant
uacuggcgccuuuaucucauuacuuugagagccaucaccagcgacuaugucguauggguaaagcgcggacgaccucucggucguccgaagcaucaaag

SEQ ID NO: 2175 - RNA, 92 nt, Artificial Sequence
  scaffold variant
uacuggcgcuuuuaucucauuacuuugagagccaucaccagcgacuaugucguauggguaaagcgccggacuucgguccggaagcaucaaag

SEQ ID NO: 2176 - RNA, 108 nt, Artificial Sequence
  scaffold variant
uacuggcgcuuuuaucggauuacuuugagagccaucaccagcgacuaugucguauggguaaagcgcuuauuuaucggagagaaauccgauaaauaagaagcaucaaag

SEQ ID NO: 2177 - RNA, 98 nt, Artificial Sequence
  scaffold variant
uacuggcgcuuuuaucucauuacuuugagagccaucaccagcgacuaugucguauggguaaagcgcggacgaccucucggucguccgaagcaucaaag

SEQ ID NO: 2178 - RNA, 89 nt, Artificial Sequence
  scaffold variant
gcuggcgcuuuuaucugauuacuuugagagccaucaccagcgacuaugucguauggguaaagcgcccucuucggagggaagcaucaaag

SEQ ID NO: 2179 - RNA, 88 nt, Artificial Sequence
  scaffold variant
gcuggcgccuuuaucugauuacuuugagagccaucaccagcgacuaugucguauggguaaagcucccucuucggagggagcaucaaag

SEQ ID NO: 2180 - RNA, 197 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaaggggucggcauggcaucuccaccuccucgcgguccgaccugggcauccgaaggaggacgcacguccacucggauggcuaagggagagcca

SEQ ID NO: 2181 - RNA, 88 nt, Artificial Sequence
  scaffold variant
gcuggcgccuuuaucugauuacuuugagagccaucaccagcgacuaugucguauggguaaagcgcccucuucggagggcgcaucaaag

SEQ ID NO: 2182 - RNA, 186 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaaguuuuggccggcauggucccagccuccucgcuggcgccggcugggcaacaugcuucggcauggcgaaugggaccccggg

SEQ ID NO: 2183 - RNA, 97 nt, Artificial Sequence
  scaffold variant
gauggcgccuuuaucucauuacuuugagagccaucaccagcgacuaugucguauggguaaagcgcuuacggacuucgguccguaagaagcaucaaag

SEQ ID NO: 2184 - RNA, 89 nt, Artificial Sequence
  scaffold variant
gcuggcgcuuuuaucucauuacuuugagagccaucaccagcgacuaugucguauggguaaagcgcccucuucggagggaagcaucaaag

SEQ ID NO: 2185 - RNA, 96 nt, Artificial Sequence
  scaffold variant
gcuggcgccuuuaucugauuacuuugagagccaucaccagcgacuaugucguauggguaaagcucuuacggacuucgguccguaagagcaucaaag

SEQ ID NO: 2186 - RNA, 96 nt, Artificial Sequence
  scaffold variant
gcuggcgccuuuaucugauuacuuugagagccaucaccagcgacuaugucguauggguaaagcucggacgaccucucggucguccgagcaucaaag

SEQ ID NO: 2187 - RNA, 160 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagccugucaccggaugugcuuuccggucugaugaguccgugaggacgaaacagg

SEQ ID NO: 2188 - RNA, 97 nt, Artificial Sequence
  scaffold variant
gcuggcgcuuuuaucugauuacuuugagagccaucaccagcgacuaugucguauggguaaagcgcggacgaccucucggucguccgaagcaucaaag

SEQ ID NO: 2189 - RNA, 97 nt, Artificial Sequence
  scaffold variant
gcuggcgccuuuaucugauuacuuugagagccaucaccagcgacuaugucguauggguaaagcgcggacgaccucucggucguccgaagcaucaaag

SEQ ID NO: 2190 - RNA, 106 nt, Artificial Sequence
  scaffold variant
gcuggcgccuuuaucugauuacuuugagagccaucaccagcgacuaugucguauggguaaagcucaggugggacgaccucucggucguccuaucugagcaucaaag

SEQ ID NO: 2191 - RNA, 177 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaaggauggccggcauggucccagccuccucgcuggcgccggcugggcaacaccuucggguggcgaaugggac

SEQ ID NO: 2192 - RNA, 107 nt, Artificial Sequence
  scaffold variant
gcuggcgcuuuuaucugauuacuuugagagccaucaccagcgacuaugucguauggguaaagcgcaggugggacgaccucucggucguccuaucugaagcaucaaag

SEQ ID NO: 2193 - RNA, 109 nt, Artificial Sequence
  scaffold variant
uacuggcgcuuuuaucucauuacuuugagagccaucaccagcgacuaugucguacuggguaaagcgcuuauuuaucggagagaaauccgauaaauaagaagcaucaaag

SEQ ID NO: 2194 - RNA, 107 nt, Artificial Sequence
  scaffold variant
uacuggcgcuuuuaucucauuacuuugagagccaucaccagcgacuaugucguauggguaaagcgcuuauuuaucgugagaaauccgauaaauaagaagcaucaaag

SEQ ID NO: 2195 - RNA, 109 nt, Artificial Sequence
  scaffold variant
guacuggcgcuuuuaucucauuacuuugagagccaucaccagcgacuaugucguauggguaaagcgcuuauuuaucggagagaaauccgauaaauaagaagcaucaaag

SEQ ID NO: 2196 - RNA, 97 nt, Artificial Sequence
  scaffold variant
gcuggcgcuuuuaucucauuacuuugagagccaucaccagcgacuaugucguauggguaaagcgcggacgaccucucggucguccgaagcaucaaag

SEQ ID NO: 2197 - RNA, 97 nt, Artificial Sequence
  scaffold variant
gcuggcgccuuuaucugauuacuuugagagccaucaccagcgacuaugucguauggguaaagcgcuuacggacuucgguccguaagaagcaucaaag

SEQ ID NO: 2198 - RNA, 107 nt, Artificial Sequence
  scaffold variant
gcuggcgcuuuuaucucauuacuuugagagccaucaccagcgacuaugucguauggguaaagcgcuuauuuaucggagagaaauccgauaaauaagaagcaucaaag

SEQ ID NO: 2199 - RNA, 97 nt, Artificial Sequence
  scaffold variant
gcuggcgccuuuaucucauuacuuugagagccaucaccagcgacuaugucguauggguaaagcgcuuacggacuucgguccguaagaagcaucaaag

SEQ ID NO: 2200 - RNA, 89 nt, Artificial Sequence
  scaffold variant
gcuggcgccuuuaucugauuacuuugagagccaucaccagcgacuaugucguauggguaaagcgcccucuucggagggaagcaucaaag

SEQ ID NO: 2201 - RNA, 107 nt, Artificial Sequence
  scaffold variant
gcuggcgcuuuuaucucauuacuuugagagccaucaccagcgacuaugucguauggguaaagcgcaggugggacgaccucucggucguccuaucugaagcaucaaag

SEQ ID NO: 2202 - RNA, 107 nt, Artificial Sequence
  scaffold variant
gcuggcgccuuuaucucauuacuuugagagccaucaccagcgacuaugucguauggguaaagcgcaggugggacgaccucucggucguccuaucugaagcaucaaag

SEQ ID NO: 2203 - RNA, 107 nt, Artificial Sequence
  scaffold variant
gcuggcgccuuuaucugauuacuuugagagccaucaccagcgacuaugucguauggguaaagcgcaggugggacgaccucucggucguccuaucugaagcaucaaag

SEQ ID NO: 2204 - RNA, 98 nt, Artificial Sequence
  scaffold variant
uacuggcgcuuuuaucugauuacuuugagagccaucaccagcgacuaugucguauggguaaagcgcuuacggacuucgguccguaagaagcaucaaag

SEQ ID NO: 2205 - RNA, 89 nt, Artificial Sequence
  scaffold variant
gcuggcgccuuuaucucauuacuuugagagccaucaccagcgacuaugucguauggguaaagcgcccucuucggagggaagcaucaaag

SEQ ID NO: 2206 - RNA, 97 nt, Artificial Sequence
  scaffold variant
gcuggcgcuuuuaucucauuacuuugagagccaucaccagcgacuaugucguauggguaaagcgcuuacggacuucgguccguaagaagcaucaaag

SEQ ID NO: 2207 - RNA, 97 nt, Artificial Sequence
  scaffold variant
gcuggcgccuuuaucucauuacuuugagagccaucaccagcgacuaugucguauggguaaagcgcggacgaccucucggucguccgaagcaucaaag

SEQ ID NO: 2208 - RNA, 177 nt, Artificial Sequence
  scaffold variant
gauggccggcauggucccagccuccucgcuggcgccggcugggcaacaccuucggguggcgaaugggacuacuggcgcuuuuaucucauuacuuugagagccaucaccagcgacuaugucguauggguaaagcgcuuauuuaucggagagaaauccgauaaauaagaagcaucaaag

SEQ ID NO: 2209 - RNA, 194 nt, Artificial Sequence
  scaffold variant
ggccggcauggucccagccuccucgcuggcgccggcugggcaacauuccgaggggaccguccccucgguaauggcgaaugggacccuacuggcgcuuuuaucucauuacuuugagagccaucaccagcgacuaugucguauggguaaagcgcuuauuuaucggagagaaauccgauaaauaagaagcaucaaag

SEQ ID NO: 2210 - RNA, 96 nt, Artificial Sequence
  scaffold variant
gcuggcgccuuuaucugauuacuuugagagccaucaccagcgacuaugucguauggguaaagcgcuuacggacuucgguccguaagcgcaucaaag

SEQ ID NO: 2211 - RNA, 172 nt, Artificial Sequence
  scaffold variant
cgugguuagggccacguuaaauaguugcuuaagcccuaagcguugaucuucggaucaggugcaauacuggcgcuuuuaucucauuacuuugagagccaucaccagcgacuaugucguauggguaaagcgcuuauuuaucggagagaaauccgauaaauaagaagcaucaaag

SEQ ID NO: 2212 - RNA, 197 nt, Artificial Sequence
  scaffold variant
gggucggcauggcaucuccaccuccucgcgguccgaccugggcauccgaaggaggacgcacguccacucggauggcuaagggagagccauacuggcgcuuuuaucucauuacuuugagagccaucaccagcgacuaugucguauggguaaagcgcuuauuuaucggagagaaauccgauaaauaagaagcaucaaag

SEQ ID NO: 2213 - RNA, 171 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagccaguacugaugaguccgugaggacgaaacgaguaagcucgucuacuggcgcuuuuaucucau

SEQ ID NO: 2214 - RNA, 99 nt, Artificial Sequence
  scaffold variant
uacuggcgccuuuaucucauuacuuuagagagccaucaccagcgacuaugucguauggguaaagcgcuuacggacuucgguccguaagaagcaucaaag

SEQ ID NO: 2215 - RNA, 157 nt, Artificial Sequence
  scaffold variant
cgacuacugaugaguccgugaggacgaaacgaguaagcucgucuagucguacuggcgcuuuuaucucauuacuuugagagccaucaccagcgacuaugucguauggguaaagcgcuuauuuaucggagagaaauccgauaaauaagaagcaucaaag

SEQ ID NO: 2216 - RNA, 106 nt, Artificial Sequence
  scaffold variant
gcuggcgccuuuaucugauuacuuugagagccaucaccagcgacuaugucguauggguaaagcgcaggugggacgaccucucggucguccuaucugcgcaucaaag

SEQ ID NO: 2217 - RNA, 97 nt, Artificial Sequence
  scaffold variant
uacuggcgccuuuaucucauuacuuuagagccaucaccagcgacuaugucguauggguaaagcgcuuacggacuucgguccguaagaagcaucaaag

SEQ ID NO: 2218 - RNA, 186 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagcauuccucagaaaaugacaaaccuguggggcguaaguagaucuucggaucuaugaucgugcagacguuaaaaucaggu

SEQ ID NO: 2219 - RNA, 171 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucgcguguagcgaagca

SEQ ID NO: 2220 - RNA, 186 nt, Artificial Sequence
  scaffold variant
cauuccucagaaaaugacaaaccuguggggcguaaguagaucuucggaucuaugaucgugcagacguuaaaaucagguuacuggcgcuuuuaucucauuacuuugagagccaucaccagcgacuaugucguauggguaaagcgcuuauuuaucggagagaaauccgauaaauaagaagcaucaaag

SEQ ID NO: 2221 - RNA, 186 nt, Artificial Sequence
  scaffold variant
uuuuggccggcauggucccagccuccucgcuggcgccggcugggcaacaugcuucggcauggcgaaugggaccccggguacuggcgcuuuuaucucauuacuuugagagccaucaccagcgacuaugucguauggguaaagcgcuuauuuaucggagagaaauccgauaaauaagaagcaucaaag

SEQ ID NO: 2222 - RNA, 171 nt, Artificial Sequence
  scaffold variant
cgacuacugaugaguccgugaggacgaaacgaguaagcucgucuagucgcguguagcgaagcauacuggcgcuuuuaucucauuacuuugagagccaucaccagcgacuaugucguauggguaaagcgcuuauuuaucggagagaaauccgauaaauaagaagcaucaaag

SEQ ID NO: 2223 - RNA, 168 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaaggggagccccgcugaugaggucggggagaccgaaagggacuucggucccuacggggcuccc

SEQ ID NO: 2224 - RNA, 144 nt, Artificial Sequence
  scaffold variant
ccacccccaccaccacccccacccccaccaccacccuacuggcgcuuuuaucucauuacuuugagagccaucaccagcgacuaugucguauggguaaagcgcuuauuuaucggagagaaauccgauaaauaagaagcaucaaag

SEQ ID NO: 2225 - RNA, 157 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucg

SEQ ID NO: 2226 - RNA, 172 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagcgugguuagggccacguuaaauaguugcuuaagcccuaagcguugaucuucggaucaggugcaa

SEQ ID NO: 2227 - RNA, 184 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagggcaauaaagcgguuacaagcccgcaaaaauagcagaguaaugucgcgauagcgcggcauuaaugcagcuuuauug

SEQ ID NO: 2228 - RNA, 122 nt, Artificial Sequence
  scaffold variant
uacuggcgcuuuuaucucauuacuauuaucucauuacuuugagagccaucaccagcgacuaugucguauggguaaagcgcuuauuuaucggagagaaauccgauaaauaagaagcaucaaag

SEQ ID NO: 2229 - RNA, 184 nt, Artificial Sequence
  scaffold variant
ggcaauaaagcgguuacaagcccgcaaaaauagcagaguaaugucgcgauagcgcggcauuaaugcagcuuuauuguacuggcgcuuuuaucucauuacuuugagagccaucaccagcgacuaugucguauggguaaagcgcuuauuuaucggagagaaauccgauaaauaagaagcaucaaag

SEQ ID NO: 2230 - RNA, 185 nt, Artificial Sequence
  scaffold variant
uacuggcgcuuuuaucucauuacuuugagagccaucaccagcgacuaugucguauggguaaagcgcuuauuuaucggagagaaauccgauaaauaagaagcaucaaagacccgcaaggccgacggcauccgccgccgcuggugcaaguccagccgccccuucgggggcgggcgcucauggguaac

SEQ ID NO: 2231 - RNA, 63 nt, Artificial Sequence
  scaffold variant
uacuggcgcuuuuaucucauuacuuugagagccaucaccagcgacuaugucguauggguaaag

SEQ ID NO: 2232 - RNA, 168 nt, Artificial Sequence
  scaffold variant
gggagccccgcugaugaggucggggagaccgaaagggacuucggucccuacggggcucccuacuggcgcuuuuaucucauuacuuugagagccaucaccagcgacuaugucguauggguaaagcgcuuauuuaucggagagaaauccgauaaauaagaagcaucaaag

SEQ ID NO: 2233 - RNA, 171 nt, Artificial Sequence
  scaffold variant
ccaguacugaugaguccgugaggacgaaacgaguaagcucgucuacuggcgcuuuuaucucauuacuggcgcuuuuaucucauuacuuugagagccaucaccagcgacuaugucguauggguaaagcgcuuauuuaucggagagaaauccgauaaauaagaagcaucaaag

SEQ ID NO: 2234 - RNA, 185 nt, Artificial Sequence
  scaffold variant
acccgcaaggccgacggcauccgccgccgcuggugcaaguccagccgccccuucgggggcgggcgcucauggguaacuacuggcgcuuuuaucucauuacuuugagagccaucaccagcgacuaugucguauggguaaagcgcuuauuuaucggagagaaauccgauaaauaagaagcaucaaag

SEQ ID NO: 2235 - RNA, 160 nt, Artificial Sequence
  scaffold variant
ccugucaccggaugugcuuuccggucugaugaguccgugaggacgaaacagguacuggcgcuuuuaucucauuacuuugagagccaucaccagcgacuaugucguauggguaaagcgcuuauuuaucggagagaaauccgauaaauaagaagcaucaaag

SEQ ID NO: 2236 - RNA, 100 nt, Artificial Sequence
  scaffold variant
guacuggcgccuuuaucucauuacuuugagagccaucaccagcgacuaugucguaguggguaaagcgcuuacggacuucgguccguaagaagcaucaaag

SEQ ID NO: 2237 - RNA, 91 nt, Artificial Sequence
  scaffold variant
guacuggcgcuuuuaucugauuacuuugagagccaucaccagcgacuaugucguaguggguaaagcucccucuucggagggagcaucaaag

SEQ ID NO: 2238 - RNA, 89 nt, Artificial Sequence
  scaffold variant
acuggcgcuuuuaucugauuacuuugagagccaucaccagcgacuaugucguaguggguaaagcucccucuucggagggagcaucaaag

SEQ ID NO: 2239 - RNA, 97 nt, Artificial Sequence
  scaffold variant
acuggcgccuuuaucucauuacuuugagagccaucaccagcgacuaugucguauggguaaagcgcuuacggacuucgguccguaagaagcaucaaag

SEQ ID NO: 2240 - RNA, 89 nt, Artificial Sequence
  scaffold variant
gcuggcgcuuuuaucugauuacuuugagagccaucaccagcgacuaugucguaguggguaaagcucccucuucggagggagcaucaaag

SEQ ID NO: 2241 - RNA, 88 nt, Artificial Sequence
  scaffold variant
acuggcgcuuuuaucugauuacuuugagagccaucaccagcgacuaugucguauggguaaagcucccucuucggagggagcaucaaag

SEQ ID NO: 2242 - RNA, 97 nt, Artificial Sequence
  scaffold variant
acuggcgccuuuaucugauuacuuugagagccaucaccagcgacuaugucguauggguaaagcgcuuacggacuucgguccguaagaagcaucaaag

SEQ ID NO: 2243 - RNA, 97 nt, Artificial Sequence
  scaffold variant
acuggcgcuuuuaucugauuacuuugagagccaucaccagcgacuaugucguauggguaaagcgcuuacggacuucgguccguaagaagcaucaaag

SEQ ID NO: 2244 - RNA, 98 nt, Artificial Sequence
  scaffold variant
acuggcgcuuuuaucugauuacuuugagagccaucaccagcgacuaugucguaguggguaaagcgcuuacggacuucgguccguaagaagcaucaaag

SEQ ID NO: 2245 - RNA, 89 nt, Artificial Sequence
  scaffold variant
acuggcgcuuuuaucugauuacuuugagagccaucaccagcgacuaugucguauuggguaaagcucccucuucggagggagcaucaaag

SEQ ID NO: 2246 - RNA, 98 nt, Artificial Sequence
  scaffold variant
acuggcgcuuuuaucugauuacuuugagagccaucaccagcgacuaugucguauuggguaaagcgcuuacggacuucgguccguaagaagcaucaaag

SEQ ID NO: 2247 - RNA, 98 nt, Artificial Sequence
  scaffold variant
acuggcgccuuuaucaucauuacuuugagagccaucaccagcgacuaugucguauggguaaagcgcuuacggacuucgguccguaagaagcaucaaag

SEQ ID NO: 2248 - RNA, 90 nt, Artificial Sequence
  scaffold variant
acuggcgcuuuuaucugauuacuuugagagccaucaccagcgacuaugucguaguggguaaagcgcccucuucggagggaagcaucaaag

SEQ ID NO: 2249 - RNA, 96 nt, Artificial Sequence
  scaffold variant
acuggcgcuuuuaucugauuacuuugagagccaucaccagcgacuaugucguaguggguaaagcucacaugaggaucacccaugugagcaucaaag

SEQ ID NO: 2250 - RNA, 89 nt, Artificial Sequence
  scaffold variant
acuggcacuuuuaccugauuacuuugagagccaacaccagcgacuaugucguaguggguaaagcucccucuucggagggagcaucaaag

SEQ ID NO: 2251 - RNA, 89 nt, Artificial Sequence
  scaffold variant
acuggcacuuuuaucugauuacuuugagagccaucaccagcgacuaugucguaguggguaaagcucccucuucggagggagcaucaaag

SEQ ID NO: 2252 - RNA, 89 nt, Artificial Sequence
  scaffold variant
acuggcccuuuuaucugauuacuuugagagccaucaccagcgacuaugucguaguggguaaagcucccucuucggagggagcaucaaag

SEQ ID NO: 2253 - RNA, 89 nt, Artificial Sequence
  scaffold variant
acuggcgcuuuuaccugauuacuuugagagccaucaccagcgacuaugucguaguggguaaagcucccucuucggagggagcaucaaag

SEQ ID NO: 2254 - RNA, 89 nt, Artificial Sequence
  scaffold variant
acuggcgcuuuuaucugauuacuuugagagccaacaccagcgacuaugucguaguggguaaagcucccucuucggagggagcaucaaag

SEQ ID NO: 2255 - RNA, 97 nt, Artificial Sequence
  scaffold variant
acuggcaccuuuaccugauuacuuugagagccaacaccagcgacuaugucguauggguaaagcgcuuacggacuucgguccguaagaagcaucaaag

SEQ ID NO: 2256 - RNA, 97 nt, Artificial Sequence
  scaffold variant
acuggcaccuuuaucugauuacuuugagagccaucaccagcgacuaugucguauggguaaagcgcuuacggacuucgguccguaagaagcaucaaag

SEQ ID NO: 2257 - RNA, 97 nt, Artificial Sequence
  scaffold variant
acuggccccuuuaucugauuacuuugagagccaucaccagcgacuaugucguauggguaaagcgcuuacggacuucgguccguaagaagcaucaaag

SEQ ID NO: 2258 - RNA, 97 nt, Artificial Sequence
  scaffold variant
acuggcgccuuuaucugauuacuuugagagccaacaccagcgacuaugucguauggguaaagcgcuuacggacuucgguccguaagaagcaucaaag

SEQ ID NO: 2259 - RNA, 89 nt, Artificial Sequence; identical to SEQ ID NO: 2240
  scaffold variant

SEQ ID NO: 2260 - RNA, 90 nt, Artificial Sequence
  scaffold variant
gacuggcgcuuuuaucugauuacuuugagagccaucaccagcgacuaugucguaguggguaaagcucccucuucggagggagcaucaaag

SEQ ID NO: 2261 - RNA, 90 nt, Artificial Sequence
  scaffold variant
acuggcgccuuuaucugauuacuuuggagagccaucaccagcgacuaugucguaguggguaaagcucccucuucggagggagcaucaaag

SEQ ID NO: 2262 - RNA, 89 nt, Artificial Sequence
  scaffold variant
acuggcgcauuuaucugauuacuuugugagccaucaccagcgacuaugucguaguggguaaagcucccucuucggagggagcaucaaag

SEQ ID NO: 2263 - RNA, 89 nt, Artificial Sequence
  scaffold variant
acuggcgccuuuaucugauuacuuugagagccaucaccagcgacuaugucguaguggguaaagcucccucuucggagggagcaucaaag

SEQ ID NO: 2264 - RNA, 90 nt, Artificial Sequence
  scaffold variant
acuggcgcuuuuaucugauuacuuuggagagccaucaccagcgacuaugucguaguggguaaagcucccucuucggagggagcaucaaag

SEQ ID NO: 2265 - RNA, 89 nt, Artificial Sequence
  scaffold variant
acuggcgcauuuaucugauuacuuugagagccaucaccagcgacuaugucguaguggguaaagcucccucuucggagggagcaucaaag

SEQ ID NO: 2266 - RNA, 89 nt, Artificial Sequence
  scaffold variant
acuggcgcuuuuaucugauuacuuugugagccaucaccagcgacuaugucguaguggguaaagcucccucuucggagggagcaucaaag

SEQ ID NO: 2267 - RNA, 90 nt, Artificial Sequence
  scaffold variant
acuggcgcuuuuauucugauuacuuugagagccaucaccagcgacuaugucguaguggguaaagcucccucuucggagggagcaucaaag

SEQ ID NO: 2268 - RNA, 88 nt, Artificial Sequence
  scaffold variant
acggcgcuuuuaucugauuacuuugagagccaucaccagcgacuaugucguaguggguaaagcucccucuucggagggagcaucaaag

SEQ ID NO: 2269 - RNA, 89 nt, Artificial Sequence
  scaffold variant
acuggcgcuuuuauaugauuacuuugagagccaucaccagcgacuaugucguaguggguaaagcucccucuucggagggagcaucaaag

SEQ ID NO: 2270 - RNA, 90 nt, Artificial Sequence
  scaffold variant
acuggcgcuuuuaucuugauuacuuugagagccaucaccagcgacuaugucguaguggguaaagcucccucuucggagggagcaucaaag

SEQ ID NO: 2271 - RNA, 89 nt, Artificial Sequence
  scaffold variant
acuggcgcuuuuaucugauuacuuugagagccagcaccagcgacuaugucguaguggguaaagcucccucuucggagggagcaucaaag

SEQ ID NO: 2272 - RNA, 89 nt, Artificial Sequence
  scaffold variant
acuggcgcuguuaucugauuacuucgagagccaucaccagcgacuaugucguaguggguaaagcucccucuucggagggagcaucgaag

SEQ ID NO: 2273 - RNA, 89 nt, Artificial Sequence
  scaffold variant
acuggcgcucuuaucugauuacuucgagagccaucaccagcgacuaugucguaguggguaaagcucccucuucggagggagcaucgaag

SEQ ID NO: 2274 - RNA, 89 nt, Artificial Sequence
  scaffold variant
acuggcgcuuguaucugauuacucugagagccaucaccagcgacuaugucguaguggguaaagcucccucuucggagggagcaucagag

SEQ ID NO: 2275 - RNA, 89 nt, Artificial Sequence
  scaffold variant
acuggcgcuucuaucugauuacucugagagccaucaccagcgacuaugucguaguggguaaagcucccucuucggagggagcaucagag

SEQ ID NO: 2276 - RNA, 89 nt, Artificial Sequence
  scaffold variant
acuggcgcuuugaucugauuaccuugagagccaucaccagcgacuaugucguaguggguaaagcucccucuucggagggagcaucaagg

SEQ ID NO: 2277 - RNA, 89 nt, Artificial Sequence
  scaffold variant
acuggcgcuuucaucugauuaccuugagagccaucaccagcgacuaugucguaguggguaaagcucccucuucggagggagcaucaagg

SEQ ID NO: 2278 - RNA, 89 nt, Artificial Sequence
  scaffold variant
acuggcgcuguuaucugauuacuuugagagccaucaccagcgacuaugucguaguggguaaagcucccucuucggagggagcaucaaag

SEQ ID NO: 2279 - RNA, 89 nt, Artificial Sequence
  scaffold variant
acuggcgcuuuuaucugauuacuuugagagccaucaccagcgacuaugucguaguggguaaagcucccucuucggagggagcaucgaag

SEQ ID NO: 2280 - RNA, 89 nt, Artificial Sequence
  scaffold variant
acuggcgcuuuuaucugauuacuucgagagccaucaccagcgacuaugucguaguggguaaagcucccucuucggagggagcaucaaag

SEQ ID NO: 2281 - RNA, 98 nt, Artificial Sequence
  scaffold variant
acuggcacuucuaucugauuacucugagagccaucaccagcgacuaugucguauggguaaagccgcuuacggacuucgguccguaagaggcaucagag

SEQ ID NO: 2282 - RNA, 89 nt, Artificial Sequence
  scaffold variant
acuggcacuucuaucugauuacucugagagccaucaccagcgacuaugucguaguggguaaagcucccucuucggagggagcaucagag

SEQ ID NO: 2283 - RNA, 98 nt, Artificial Sequence
  scaffold variant
acuggcaccuuuaucugauuacuuugagagccaucaccagcgacuaugucguauggguaaagccgcuuacggacuucgguccguaagaggcaucaaag

SEQ ID NO: 2284 - RNA, 98 nt, Artificial Sequence
  scaffold variant
acuggcacuuguaucugauuacucugagagccaucaccagcgacuaugucguauggguaaagccgcuuacggacuucgguccguaagaggcaucagag

SEQ ID NO: 2285 - RNA, 89 nt, Artificial Sequence
  scaffold variant
acuggcacuuguaucugauuacucugagagccaucaccagcgacuaugucguaguggguaaagcucccucuucggagggagcaucagag

SEQ ID NO: 2286 - RNA, 97 nt, Artificial Sequence
  scaffold variant
acuggcacuuuuaucugauuacuuugagagccaucaccagcgacuaugucguauggguaaagcgcuuacggacuucgguccguaagaagcaucaaag

SEQ ID NO: 2287 - RNA, 97 nt, Artificial Sequence
  scaffold variant
acuggcacuucuaucugauuacucugagagccaucaccagcgacuaugucguauggguaaagcgcuuacggacuucgguccguaagaagcaucagag

SEQ ID NO: 2288 - RNA, 98 nt, Artificial Sequence
  scaffold variant
acuggcgcuucuaucugauuacucugagagccaucaccagcgacuaugucguauggguaaagccgcuuacggacuucgguccguaagaggcaucagag

SEQ ID NO: 2289 - RNA, 98 nt, Artificial Sequence
  scaffold variant
acuggcacuucuaucugauuacucugagcgccaucaccagcgacuaugucguauggguaaagccgcuuacggacuucgguccguaagaggcaucagag

SEQ ID NO: 2290 - RNA, 98 nt, Artificial Sequence
  scaffold variant
acuggcgcuucuaucugauuacucugagcgccaucaccagcgacuaugucguauggguaaagccgcuuacggacuucgguccguaagaggcaucagag

SEQ ID NO: 2291 - RNA, 98 nt, Artificial Sequence
  scaffold variant
acuggcgcuucuaucugauuacucugagcgccaucaccagcgacuaugucguauggguaaagcgccuuacggacuucgguccguaaggagcaucagag

SEQ ID NO: 2292 - RNA, 99 nt, Artificial Sequence; identical to SEQ ID NO: 1067
  scaffold variant

SEQ ID NO: 2293 - RNA, 98 nt, Artificial Sequence
  scaffold variant
acgggacuuucuaucugauuacucugaagucccucaccagcgacuaugucguauggguaaagccgcuuacggacuucgguccguaagaggcaucagag

SEQ ID NO: 2294 - RNA, 98 nt, Artificial Sequence
  scaffold variant
accuguaguucuaucugauuacucugacuacagucaccagcgacuaugucguauggguaaagccgcuuacggacuucgguccguaagaggcaucagag

SEQ ID NO: 2295 - RNA, 113 nt, Artificial Sequence
  scaffold variant
acuggcgcuuuuaucugauuacuuugagagccaucaccagcgacuaugucguaguggguaaagcugcacggugggcgcagcuucggcugacgguacaccgugcagcaucaaag

SEQ ID NO: 2296 - RNA, 143 nt, Artificial Sequence
  scaffold variant
acuggcgcuuuuaucugauuacuuugagagccaucaccagcgacuaugucguaguggguaaagcugcacggugggcgcagcuucggcugacgguacaccggugggcgcagcuucggcugacgguacaccgugcagcaucaaag

SEQ ID NO: 2297 - RNA, 173 nt, Artificial Sequence
  scaffold variant
acuggcgcuuuuaucugauuacuuugagagccaucaccagcgacuaugucguaguggguaaagcugcacggugggcgcagcuucggcugacgguacaccggugggcgcagcuucggcugacgguacaccggugggcgcagcuucggcugacgguacaccgugcagcaucaaag

SEQ ID NO: 2298 - RNA, 203 nt, Artificial Sequence
  scaffold variant
acuggcgcuuuuaucugauuacuuugagagccaucaccagcgacuaugucguaguggguaaagcugcacggugggcgcagcuucggcugacgguacaccggugggcgcagcuucggcugacgguacaccggugggcgcagcuucggcugacgguacaccggugggcgcagcuucggcugacgguacaccgugcagcaucaaag

SEQ ID NO: 2299 - RNA, 233 nt, Artificial Sequence
  scaffold variant
acuggcgcuuuuaucugauuacuuugagagccaucaccagcgacuaugucguaguggguaaagcugcacggugggcgcagcuucggcugacgguacaccggugggcgcagcuucggcugacgguacaccggugggcgcagcuucggcugacgguacaccggugggcgcagcuucggcugacgguacaccggugggcgcagcuucggcugacgguacaccgugcagcaucaaag

SEQ ID NO: 2300 - RNA, 97 nt, Artificial Sequence
  scaffold variant
acuggcgcuuuuaucugauuacuuugagagccaucaccagcgacuaugucguaguggguaaagcugcaccuagcggaggcuaggugcagcaucaaag

SEQ ID NO: 2301 - RNA, 118 nt, Artificial Sequence
  scaffold variant
acuggcgcuuuuaucugauuacuuugagagccaucaccagcgacuaugucguaguggguaaagcugcaccucggcuugcugaagcgcgcacggcaagaggcgaggugcagcaucaaag

SEQ ID NO: 2302 - RNA, 192 nt, Artificial Sequence
  scaffold variant
acuggcgcuuuuaucugauuacuuugagagccaucaccagcgacuaugucguaguggguaaagcugcaccucucucgacgcaggacucggcuugcugaagcgcgcacggcaagaggcgaggggcggcgacuggugaguacgccaaaaauuuugacuagcggaggcuagaaggagagaggugcagcaucaaag

SEQ ID NO: 2303 - RNA, 156 nt, Artificial Sequence
  scaffold variant
acuggcgcuuuuaucugauuacuuugagagccaucaccagcgacuaugucguaguggguaaagcugcacggugcccgucuguugugucgagagacgccaaaaauuuugacuagcggaggcuagaaggagagagaugggugccgugcagcaucaaag

SEQ ID NO: 2304 - RNA, 96 nt, Artificial Sequence
  scaffold variant
acuggcgcuuuuaucugauuacuuugagagccaucaccagcgacuaugucguaguggguaaagcugcacauggagaggagaugugcagcaucaaag

SEQ ID NO: 2305 - RNA, 91 nt, Artificial Sequence
  scaffold variant
acuggcgcuuuuaucugauuacuuugagagccaucaccagcgacuaugucguaguggguaaagcugcacauggagaugugcagcaucaaag

SEQ ID NO: 2306 - RNA, 106 nt, Artificial Sequence
  scaffold variant
acuggcgcuuuuaucugauuacuuugagagccaucaccagcgacuaugucguaguggguaaagcuugggcgcagcgucaaugacgcugacgguacaagcaucaaag

SEQ ID NO: 2307 - RNA, 145 nt, Artificial Sequence
  scaffold variant
acuggcgcuuuuaucugauuacuuugagagccaucaccagcgacuaugucguaguggguaaagcugcacuaugggcgcagcgucaaugacgcugacgguacaggccacaugaggaucacccaugugguauagugcagcaucaaag

SEQ ID NO: 2308 - RNA, 155 nt, Artificial Sequence
  scaffold variant
acuggcgcuuuuaucugauuacuuugagagccaucaccagcgacuaugucguaguggguaaagcugcacuaugggcgcagcucaugaggaucacccaugagcugacgguacaggccacaugaggaucacccaugugguauagugcagcaucaaag

SEQ ID NO: 2309 - RNA, 151 nt, Artificial Sequence
  scaffold variant
acuggcgcuuuuaucugauuacuuugagagccaucaccagcgacuaugucguaguggguaaagcugcacuaugggcgcagcgucaaugacgcugacgguacaggccacauggcagucguaacgacgcgggugguauagugcagcaucaaag

SEQ ID NO: 2310 - RNA, 172 nt, Artificial Sequence
  scaffold variant
acuggcgcuuuuaucugauuacuuugagagccaucaccagcgacuaugucguaguggguaaagcugcacuaugggcgcagcaaacauggcaguccuaaggacgcggguuuugcugacgguacaggccacauggcagucguaacgacgcgggugguauagugcagcaucaaag

SEQ ID NO: 2311 - RNA, 159 nt, Artificial Sequence
  scaffold variant
acuggcgcuuuuaucugauuacuuugagagccaucaccagcgacuaugucguaguggguaaagcugcacuaugggcgcagacauggcagucguaacgacgcgggucugacgguacaggccacaugaggaucacccaugugguauagugcagcaucaaag

SEQ ID NO: 2312 - RNA, 108 nt, Artificial Sequence
  scaffold variant
acuggcgcuuuuaucugauuacuuugagagccaucaccagcgacuaugucguaguggguaaagcugcacuaaggaguuuauauggaaacccuuagugcagcaucaaag

SEQ ID NO: 2313 - RNA, 242 nt, Artificial Sequence
  scaffold variant
acuggcgcuuuuaucugauuacuuugagagccaucaccagcgacuaugucguaguggguaaagcucaggaagcacuaugggcgcagcgucaaugacgcugacgguacaggccagacaauuauugucugguauagugcagcagcagaacaauuugcugagggcuauugaggcgcaacagcaucuguugcaacucacagucuggggcaucaagcagcuccaggcaagaauccugagcaucaaag

SEQ ID NO: 2314 - RNA, 98 nt, Artificial Sequence
  scaffold variant
acuggcgcuuuuaucugauuacuuugagagccaucaccagcgacuaugucguaguggguaaagcugcacgcccugaagaagggcgugcagcaucaaag

SEQ ID NO: 2315 - RNA, 111 nt, Artificial Sequence
  scaffold variant
acuggcgcuuuuaucugauuacuuugagagccaucaccagcgacuaugucguaguggguaaagcugcacggcucguguagcucauuagcuccgagccgugcagcaucaaag

SEQ ID NO: 2316 - RNA, 113 nt, Artificial Sequence
  scaffold variant
acuggcgcuuuuaucugauuacuuugagagccaucaccagcgacuaugucguaguggguaaagcugcacccgugugcauccgcagugucggauccacgggugcagcaucaaag

SEQ ID NO: 2317 - RNA, 112 nt, Artificial Sequence
  scaffold variant
acuggcgcuuuuaucugauuacuuugagagccaucaccagcgacuaugucguaguggguaaagcugcacggaauccauugcacuccggauuucacuaggugcagcaucaaag

SEQ ID NO: 2318 - RNA, 103 nt, Artificial Sequence
  scaffold variant
acuggcgcuuuuaucugauuacuuugagagccaucaccagcgacuaugucguaguggguaaagcugcacaugcaugucuaagacagcaugugcagcaucaaag

SEQ ID NO: 2319 - RNA, 106 nt, Artificial Sequence
  scaffold variant
acuggcgcuuuuaucugauuacuuugagagccaucaccagcgacuaugucguaguggguaaagcugcacaaaacauaaggaaaaccuauguugugcagcaucaaag

SEQ ID NO: 2320 - RNA, 153 nt, Artificial Sequence
  scaffold variant
acuggcgcuucuaucugauuacucugagcgccaucaccagcgacuaugucguaguggguaaagccgcuuacggacuaugggcgcagcgucaaugacgcugacgguacaggccagacaauuauugucugguauaguccguaagaggcaucagag

SEQ ID NO: 2321 - RNA, 147 nt, Artificial Sequence
  scaffold variant
acuggcgcuucuaucugauuacucugagcgccaucaccagcgacuaugucguaguggguaaagccgcuuacgggugggcgcagcgucaaugacgcugacgguacaggccagacaauuauugucugguacccguaagaggcaucagag

SEQ ID NO: 2322 - RNA, 153 nt, Artificial Sequence
  scaffold variant
acuggcgcuucuaucugauuacucugagcgccaucaccagcgacuaugucguaguggguaaagccgcuuacgguaugggcgcagcgucaaugacgcugacgguacaggccacaugaggaucacccaugugguauaccguaagaggcaucagag

SEQ ID NO: 2323 - RNA, 143 nt, Artificial Sequence
  scaffold variant
acuggcgcuuuuaucugauuacuuugagagccaucaccagcgacuaugucguaguggguaaagcucccuaugggcgcagcgucaaugacgcugacgguacaggccacaugaggaucacccaugugguauagggagcaucaaag

SEQ ID NO: 2324 - RNA, 163 nt, Artificial Sequence
  scaffold variant
acuggcgcuucuaucugauuacucugagcgccaucaccagcgacuaugucguaguggguaaagccgcuuacgguaugggcgcagcucaugaggaucacccaugagcugacgguacaggccacaugaggaucacccaugugguauaccguaagaggcaucagag

SEQ ID NO: 2325 - RNA, 153 nt, Artificial Sequence
  scaffold variant
acuggcgcuuuuaucugauuacuuugagagccaucaccagcgacuaugucguaguggguaaagcucccuaugggcgcagcucaugaggaucacccaugagcugacgguacaggccacaugaggaucacccaugugguauagggagcaucaaag

SEQ ID NO: 2326 - RNA, 159 nt, Artificial Sequence
  scaffold variant
acuggcgcuucuaucugauuacucugagcgccaucaccagcgacuaugucguaguggguaaagccgcuuacgguaugggcgcagcgucaaugacgcugacgguacaggccacauggcagucguaacgacgcgggugguauaccguaagaggcaucagag

SEQ ID NO: 2327 - RNA, 149 nt, Artificial Sequence
  scaffold variant
acuggcgcuuuuaucugauuacuuugagagccaucaccagcgacuaugucguaguggguaaagcucccuaugggcgcagcgucaaugacgcugacgguacaggccacauggcagucguaacgacgcgggugguauagggagcaucaaag

SEQ ID NO: 2328 - RNA, 180 nt, Artificial Sequence
  scaffold variant
acuggcgcuucuaucugauuacucugagcgccaucaccagcgacuaugucguaguggguaaagccgcuuacgguaugggcgcagcaaacauggcaguccuaaggacgcggguuuugcugacgguacaggccacauggcagucguaacgacgcgggugguauaccguaagaggcaucagag

SEQ ID NO: 2329 - RNA, 170 nt, Artificial Sequence
  scaffold variant
acuggcgcuuuuaucugauuacuuugagagccaucaccagcgacuaugucguaguggguaaagcucccuaugggcgcagcaaacauggcaguccuaaggacgcggguuuugcugacgguacaggccacauggcagucguaacgacgcgggugguauagggagcaucaaag

SEQ ID NO: 2330 - RNA, 167 nt, Artificial Sequence
  scaffold variant
acuggcgcuucuaucugauuacucugagcgccaucaccagcgacuaugucguaguggguaaagccgcuuacgguaugggcgcagacauggcagucguaacgacgcgggucugacgguacaggccacaugaggaucacccaugugguauaccguaagaggcaucagag

SEQ ID NO: 2331 - RNA, 157 nt, Artificial Sequence
  scaffold variant
acuggcgcuuuuaucugauuacuuugagagccaucaccagcgacuaugucguaguggguaaagcucccuaugggcgcagacauggcagucguaacgacgcgggucugacgguacaggccacaugaggaucacccaugugguauagggagcaucaaag

SEQ ID NO: 2332 - RNA, 141 nt, Artificial Sequence
  scaffold variant
acuggcgcuuuuaucugauuacuuugagagccaucaccagcgacuaugucguaguggguaaagcugcacuaugggcgcagcgucaaugacgcugacgguacaggccagacaauuauugucugguauagugcagcaucaaag

SEQ ID NO: 2333 - protein, 54 aa, Artificial Sequence
  CasX domain sequence
EKRINKIRKKLSADNATKPVSRSGPMKTLLVRVMTDDLKKRLEKRRKKPEVMPQ

SEQ ID NO: 2334 - protein, 44 aa, Artificial Sequence
  CasX domain sequence
VISNNAANNLRMLLDDYTKMKEAILQVYWQEFKDDHVGLMCKFA

SEQ ID NO: 2335 - protein, 91 aa, Artificial Sequence
  CasX domain sequence
QPASKKIDQNKLKPEMDEKGNLTTAGFACSQCGQPLFVYKLEQVSEKGKAYTNYFGRCNVAEHEKLILLAQLKPEKDSDEAVTYSLGKFGQ

SEQ ID NO: 2336 - protein, 141 aa, Artificial Sequence
  CasX domain sequence
RALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSF

SEQ ID NO: 2337 - protein, 177 aa, Artificial Sequence
  CasX domain sequence
PVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAE

SEQ ID NO: 2338 - protein, 151 aa, Artificial Sequence
  CasX domain sequence
NRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVD

SEQ ID NO: 2339 - protein, 164 aa, Artificial Sequence
  CasX domain sequence
PSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTC

SEQ ID NO: 2340 - protein, 110 aa, Artificial Sequence
  CasX domain sequence
SNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVH

SEQ ID NO: 2341 - protein, 53 aa, Artificial Sequence
  CasX domain sequence
ADEQAALNIARSWLFLNSNSTEFKSYKSGKQPFVGAWQAFYKRRLKEVWKPNA

SEQ ID NO: 2342 - protein, 56 aa, Artificial Sequence
  CasX domain sequence
QEIKRINKIRRRLVKDSNTKKAGKTGPMKTLLVRVMTPDLRERLENLRKKPENIPQ

SEQ ID NO: 2343 - protein, 44 aa, Artificial Sequence
  CasX domain sequence
PISNTSRANLNKLLTDYTEMKKAILHVYWEEFQKDPVGLMSRVA

SEQ ID NO: 2344 - protein, 90 aa, Artificial Sequence
  CasX domain sequence
QPAPKNIDQRKLIPVKDGNERLTSSGFACSQCCQPLYVYKLEQVNDKGKPHTNYFGRCNVSEHERLILLSPHKPEANDELVTYSLGKFGQ

SEQ ID NO: 2345 - protein, 141 aa, Artificial Sequence
  CasX domain sequence
RALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSF

SEQ ID NO: 2346 - protein, 168 aa, Artificial Sequence
  CasX domain sequence
PLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAE

SEQ ID NO: 2347 - protein, 146 aa, Artificial Sequence
  CasX domain sequence
NSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLD

SEQ ID NO: 2348 - protein, 164 aa, Artificial Sequence
  CasX domain sequence
SSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTC

SEQ ID NO: 2349 - protein, 110 aa, Artificial Sequence
  CasX domain sequence
SNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETH

SEQ ID NO: 2350 - protein, 58 aa, Artificial Sequence
  CasX domain sequence
ADEQAALNIARSWLFLRSQEYKKYQTNKTTGNTDKRAFVETWQSFYRKKLKEVWKPAV

SEQ ID NO: 2351 - protein, 168 aa, Artificial Sequence
  CasX domain sequence
PLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAE

SEQ ID NO: 2352 - protein, 164 aa, Artificial Sequence
  CasX domain sequence
SSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTC

SEQ ID NO: 2353 - RNA, 155 nt, Artificial Sequence
  scaffold variant
acuggcgcuuuuaucugauuacuuugagagccaucaccagcgacuaugucguaguggguaaagcugcacuaugggcgcagcaccugaggaucacccaggugcugacgguacaggccaccugaggaucacccaggugguauagugcagcaucaaag

SEQ ID NO: 2354 - RNA, 155 nt, Artificial Sequence
  scaffold variant
acuggcgcuuuuaucugauuacuuugagagccaucaccagcgacuaugucguaguggguaaagcugcacuaugggcgcagcgcaugaggaucacccaugcgcugacgguacaggccgcaugaggaucacccaugcgguauagugcagcaucaaag

SEQ ID NO: 2355 - RNA, 155 nt, Artificial Sequence
  scaffold variant
acuggcgcuuuuaucugauuacuuugagagccaucaccagcgacuaugucguaguggguaaagcugcacuaugggcgcagcgccugaggaucacccaggcgcugacgguacaggccgccugaggaucacccaggcgguauagugcagcaucaaag

SEQ ID NO: 2356 - RNA, 155 nt, Artificial Sequence
  scaffold variant
acuggcgcuuuuaucugauuacuuugagagccaucaccagcgacuaugucguaguggguaaagcugcacuaugggcgcagcgccugagcaucagccaggcgcugacgguacaggccgccugagcaucagccaggcgguauagugcagcaucaaag

SEQ ID NO: 2357 - RNA, 155 nt, Artificial Sequence
  scaffold variant
acuggcgcuuuuaucugauuacuuugagagccaucaccagcgacuaugucguaguggguaaagcugcacuaugggcgcagcacaugagcaucagccaugugcugacgguacaggccacaugagcaucagccaugugguauagugcagcaucaaag

SEQ ID NO: 2358 - RNA, 155 nt, Artificial Sequence
  scaffold variant
acuggcgcuuuuaucugauuacuuugagagccaucaccagcgacuaugucguaguggguaaagcugcacuaugggcgcagcacaugaguaucaaccaugugcugacgguacaggccacaugaguaucaaccaugugguauagugcagcaucaaag

SEQ ID NO: 2359 - RNA, 155 nt, Artificial Sequence
  scaffold variant
acuggcgcuuuuaucugauuacuuugagagccaucaccagcgacuaugucguaguggguaaagcugcacuaugggcgcagcacaugagaaucagccaugugcugacgguacaggccacaugagaaucagccaugugguauagugcagcaucaaag

SEQ ID NO: 2360 - RNA, 155 nt, Artificial Sequence
  scaffold variant
acuggcgcuuuuaucugauuacuuugagagccaucaccagcgacuaugucguaguggguaaagcugcacuaugggcgcagcccuugaggaucacccaugugcugacgguacaggccccuugaggaucacccaugugguauagugcagcaucaaag

SEQ ID NO: 2361 - RNA, 155 nt, Artificial Sequence
  scaffold variant
acuggcgcuuuuaucugauuacuuugagagccaucaccagcgacuaugucguaguggguaaagcugcacuaugggcgcagcacuugaggaucacccaugugcugacgguacaggccacuugaggaucacccaugugguauagugcagcaucaaag

SEQ ID NO: 2362 - RNA, 155 nt, Artificial Sequence
  scaffold variant
acuggcgcuuuuaucugauuacuuugagagccaucaccagcgacuaugucguaguggguaaagcugcacuaugggcgcagcaccugaggaucacccaugugcugacgguacaggccaccugaggaucacccaugugguauagugcagcaucaaag

SEQ ID NO: 2363 - RNA, 155 nt, Artificial Sequence
  scaffold variant
acuggcgcuuuuaucugauuacuuugagagccaucaccagcgacuaugucguaguggguaaagcugcacuaugggcgcagcacaugaggaucaccuaugugcugacgguacaggccacaugaggaucaccuaugugguauagugcagcaucaaag

SEQ ID NO: 2364 - RNA, 155 nt, Artificial Sequence
  scaffold variant
acuggcgcuuuuaucugauuacuuugagagccaucaccagcgacuaugucguaguggguaaagcugcacuaugggcgcagcacauuaggaucaccaaugugcugacgguacaggccacauuaggaucaccaaugugguauagugcagcaucaaag

SEQ ID NO: 2365 - RNA, 155 nt, Artificial Sequence
  scaffold variant
acuggcgcuuuuaucugauuacuuugagagccaucaccagcgacuaugucguaguggguaaagcugcacuaugggcgcagcacauuaggaucaccgaugugcugacgguacaggccacauuaggaucaccgaugugguauagugcagcaucaaag

SEQ ID NO: 2366 - RNA, 155 nt, Artificial Sequence
  scaffold variant
acuggcgcuuuuaucugauuacuuugagagccaucaccagcgacuaugucguaguggguaaagcugcacuaugggcgcagcacauuaggaucaccuaugugcugacgguacaggccacauuaggaucaccuaugugguauagugcagcaucaaag

SEQ ID NO: 2367 - RNA, 155 nt, Artificial Sequence
  scaffold variant
acuggcgcuuuuaucugauuacuuugagagccaucaccagcgacuaugucguaguggguaaagcugcacuaugggcgcagcacaugaggauuacccaugugcugacgguacaggccacaugaggauuacccaugugguauagugcagcaucaaag

SEQ ID NO: 2368 - RNA, 155 nt, Artificial Sequence
  scaffold variant
acuggcgcuuuuaucugauuacuuugagagccaucaccagcgacuaugucguaguggguaaagcugcacuaugggcgcagcacaugaggauaacccaugugcugacgguacaggccacaugaggauaacccaugugguauagugcagcaucaaag

SEQ ID NO: 2369 - RNA, 155 nt, Artificial Sequence
  scaffold variant
acuggcgcuuuuaucugauuacuuugagagccaucaccagcgacuaugucguaguggguaaagcugcacuaugggcgcagcacaugaggaugacccaugugcugacgguacaggccacaugaggaugacccaugugguauagugcagcaucaaag

SEQ ID NO: 2370 - RNA, 155 nt, Artificial Sequence
  scaffold variant
acuggcgcuuuuaucugauuacuuugagagccaucaccagcgacuaugucguaguggguaaagcugcacuaugggcgcagcacaugaggaccacccaugugcugacgguacaggccacaugaggaccacccaugugguauagugcagcaucaaag

SEQ ID NO: 2371 - RNA, 155 nt, Artificial Sequence
  scaffold variant
acuggcgcuuuuaucugauuacuuugagagccaucaccagcgacuaugucguaguggguaaagcugcacuaugggcgcagcagaugaggaucacccaugggcugacgguacaggccagaugaggaucacccaugggguauagugcagcaucaaag

SEQ ID NO: 2372 - RNA, 155 nt, Artificial Sequence
  scaffold variant
acuggcgcuuuuaucugauuacuuugagagccaucaccagcgacuaugucguaguggguaaagcugcacuaugggcgcagcacauggggaucacccaugugcugacgguacaggccacauggggaucacccaugugguauagugcagcaucaaag

SEQ ID NO: 2373 - RNA, 155 nt, Artificial Sequence
  scaffold variant
acuggcgcuuuuaucugauuacuuugagagccaucaccagcgacuaugucguaguggguaaagcugcacuaugggcgcagcacaugaggaucacccaugugcugacgguacaggccacaugaggaucacccaugugguauagugcagcaucaaag

SEQ ID NO: 2374 - RNA, 96 nt, Artificial Sequence
  scaffold variant
acuggcgcuuuuaucugauuacuuugagagccaucaccagcgacuaugucguaguggguaaagcucaccugaggaucacccaggugagcaucaaag

SEQ ID NO: 2375 - RNA, 96 nt, Artificial Sequence
  scaffold variant
acuggcgcuuuuaucugauuacuuugagagccaucaccagcgacuaugucguaguggguaaagcucgcaugaggaucacccaugcgagcaucaaag

SEQ ID NO: 2376 - RNA, 96 nt, Artificial Sequence
  scaffold variant
acuggcgcuuuuaucugauuacuuugagagccaucaccagcgacuaugucguaguggguaaagcucgccugaggaucacccaggcgagcaucaaag

SEQ ID NO: 2377 - RNA, 96 nt, Artificial Sequence
  scaffold variant
acuggcgcuuuuaucugauuacuuugagagccaucaccagcgacuaugucguaguggguaaagcucgccugagcaucagccaggcgagcaucaaag

SEQ ID NO: 2378 - RNA, 96 nt, Artificial Sequence
  scaffold variant
acuggcgcuuuuaucugauuacuuugagagccaucaccagcgacuaugucguaguggguaaagcucacaugagcaucagccaugugagcaucaaag

SEQ ID NO: 2379 - RNA, 96 nt, Artificial Sequence
  scaffold variant
acuggcgcuuuuaucugauuacuuugagagccaucaccagcgacuaugucguaguggguaaagcucacaugaguaucaaccaugugagcaucaaag

SEQ ID NO: 2380 - RNA, 96 nt, Artificial Sequence
  scaffold variant
acuggcgcuuuuaucugauuacuuugagagccaucaccagcgacuaugucguaguggguaaagcucacaugagaaucagccaugugagcaucaaag

SEQ ID NO: 2381 - RNA, 96 nt, Artificial Sequence
  scaffold variant
acuggcgcuuuuaucugauuacuuugagagccaucaccagcgacuaugucguaguggguaaagcucccuugaggaucacccaugugagcaucaaag

SEQ ID NO: 2382 - RNA, 96 nt, Artificial Sequence
  scaffold variant
acuggcgcuuuuaucugauuacuuugagagccaucaccagcgacuaugucguaguggguaaagcucacuugaggaucacccaugugagcaucaaag

SEQ ID NO: 2383 - RNA, 96 nt, Artificial Sequence
  scaffold variant
acuggcgcuuuuaucugauuacuuugagagccaucaccagcgacuaugucguaguggguaaagcucaccugaggaucacccaugugagcaucaaag

SEQ ID NO: 2384 - RNA, 96 nt, Artificial Sequence
  scaffold variant
acuggcgcuuuuaucugauuacuuugagagccaucaccagcgacuaugucguaguggguaaagcucacaugaggaucaccuaugugagcaucaaag

SEQ ID NO: 2385 - RNA, 96 nt, Artificial Sequence
  scaffold variant
acuggcgcuuuuaucugauuacuuugagagccaucaccagcgacuaugucguaguggguaaagcucacauuaggaucaccaaugugagcaucaaag

SEQ ID NO: 2386 - RNA, 96 nt, Artificial Sequence
  scaffold variant
acuggcgcuuuuaucugauuacuuugagagccaucaccagcgacuaugucguaguggguaaagcucacauuaggaucaccgaugugagcaucaaag

SEQ ID NO: 2387 - RNA, 96 nt, Artificial Sequence
  scaffold variant
acuggcgcuuuuaucugauuacuuugagagccaucaccagcgacuaugucguaguggguaaagcucacauuaggaucaccuaugugagcaucaaag

SEQ ID NO: 2388 - RNA, 96 nt, Artificial Sequence
  scaffold variant
acuggcgcuuuuaucugauuacuuugagagccaucaccagcgacuaugucguaguggguaaagcucacaugaggauuacccaugugagcaucaaag

SEQ ID NO: 2389 - RNA, 96 nt, Artificial Sequence
  scaffold variant
acuggcgcuuuuaucugauuacuuugagagccaucaccagcgacuaugucguaguggguaaagcucacaugaggauaacccaugugagcaucaaag

SEQ ID NO: 2390 - RNA, 96 nt, Artificial Sequence
  scaffold variant
acuggcgcuuuuaucugauuacuuugagagccaucaccagcgacuaugucguaguggguaaagcucacaugaggaugacccaugugagcaucaaag

SEQ ID NO: 2391 - RNA, 96 nt, Artificial Sequence
  scaffold variant
acuggcgcuuuuaucugauuacuuugagagccaucaccagcgacuaugucguaguggguaaagcucacaugaggaccacccaugugagcaucaaag

SEQ ID NO: 2392 - RNA, 96 nt, Artificial Sequence
  scaffold variant
acuggcgcuuuuaucugauuacuuugagagccaucaccagcgacuaugucguaguggguaaagcucagaugaggaucacccaugggagcaucaaag

SEQ ID NO: 2393 - RNA, 96 nt, Artificial Sequence
  scaffold variant
acuggcgcuuuuaucugauuacuuugagagccaucaccagcgacuaugucguaguggguaaagcucacauggggaucacccaugugagcaucaaag

SEQ ID NO: 2394 - RNA, 96 nt, Artificial Sequence
  scaffold variant
acuggcgcuucuaucugauuacucugagcgccaucaccagcgacuaugucguaguggguaaagcucacaugaggaucacccaugugagcaucagag

SEQ ID NO: 2395 - RNA, 145 nt, Artificial Sequence
  scaffold variant
acuggcgcuucuaucugauuacucugagcgccaucaccagcgacuaugucguaguggguaaagcugcacuaugggcgcagcgucaaugacgcugacgguacaggccacaugaggaucacccaugugguauagugcagcaucagag

SEQ ID NO: 2396 - RNA, 155 nt, Artificial Sequence
  scaffold variant
acuggcgcuucuaucugauuacucugagcgccaucaccagcgacuaugucguaguggguaaagcugcacuaugggcgcagcucaugaggaucacccaugagcugacgguacaggccacaugaggaucacccaugugguauagugcagcaucagag

SEQ ID NO: 2397 - RNA, 159 nt, Artificial Sequence
  scaffold variant
acuggcgcuucuaucugauuacucugagcgccaucaccagcgacuaugucguaguggguaaagcugcacuaugggcgcagacauggcagucguaacgacgcgggucugacgguacaggccacaugaggaucacccaugugguauagugcagcaucagag

SEQ ID NO: 2398 - RNA, 145 nt, Artificial Sequence
  scaffold variant
acuggcgcuuuuaucugauuacuuugagagccaucaccagcgacuaugucguaguggguaaagcugcacuauggggccacaugaggaucacccaugugguguacagcgcagcgucaaugacgcugacgauagugcagcaucaaag

What is claimed is:

1. A chimeric Class 2, Type V CRISPR protein comprising:
   a. a non-target strand binding (NTSB) domain obtained from Deltaproteobacteria comprising the sequence of SEQ ID NO: 2335, or a sequence having at least 90%, at least 95%, at least 96%, at least 97%, at least 98% or at least 99% identity thereto;
   b. a helical I-II domain obtained from Deltaproteobacteria comprising the sequence of SEQ ID NO: 2336, or a sequence having at least 90%, at least 95%, at least 96%, at least 97%, at least 98% or at least 99% identity thereto; and
   c. a RuvC-I domain obtained from Planctomycetes comprising the sequence of SEQ ID NO: 2352, or a sequence having at least 90%, at least 95%, at least 96%, at least 97%, at least 98% or at least 99% identity thereto, wherein the RuvC-I domain comprises a proline amino acid residue at position 793 relative to SEQ ID NO: 336, and wherein the chimeric Class 2, Type V CRISPR protein exhibits improved specificity relative to SEQ ID NO: 336.

2. The chimeric Class 2, Type V CRISPR protein of claim 1, comprising a helical I-I domain, a helical II domain, an oligonucleotide binding domain (OBD)-I domain, an OBD-II, a target strand loading (TSL) domain, and a RuvC-II domain.

3. The chimeric Class 2, Type V CRISPR protein of claim 2, wherein the helical I-I domain, helical II domain, OBD-I domain, OBD-II, TSL domain, and RuvC-II domain are each obtained from Planctomycetes.

4. The chimeric Class 2, Type V CRISPR protein of claim 3, wherein the helical I-I domain obtained from Planctomycetes comprises the sequence of SEQ ID NO: 2343, or a sequence having at least 90%, at least 95%, at least 96%, at least 97%, at least 98%, or at least 99% identity thereto.

5. The chimeric Class 2, Type V CRISPR protein of claim 3, wherein the helical II domain obtained from Planctomycetes comprises the sequence of SEQ ID NO: 2351, or a sequence having at least 90%, at least 95%, at least 96%, at least 97%, at least 98% or at least 99% identity thereto.

6. The chimeric Class 2, Type V CRISPR protein of claim 3, wherein the OBD-I domain obtained from Planctomycetes comprises the sequence of SEQ ID NO: 2342, or a sequence having at least 90%, at least 95%, at least 96%, at least 97%, at least 98%, or at least 99% identity thereto.

7. The chimeric Class 2, Type V CRISPR protein of claim 3, wherein the OBD-II domain obtained from Planctomycetes comprises the sequence of SEQ ID NO: 2347, or a sequence having at least 90%, at least 95%, at least 96%, at least 97%, at least 98%, or at least 99% identity thereto.

8. The chimeric Class 2, Type V CRISPR protein of claim 3, wherein the TSL domain obtained from Planctomycetes comprises the sequence of SEQ ID NO: 2349, or a sequence having at least 80%, at least 90%, at least 95%, at least 96%, at least 97%, at least 98%, or at least 99% identity thereto.

9. The chimeric Class 2, Type V CRISPR protein of claim 3, wherein the RuvC-II domain obtained from Planctomycetes comprises the sequence of SEQ ID NO: 2350, or a sequence having at least 90%, at least 95%, at least 96%, at least 97%, at least 98%, or at least 99% identity thereto.

10. The chimeric Class 2, Type V CRISPR protein of claim 1, wherein the RuvC-I domain comprises a substitution at amino acid position A708 relative to the Planctomycetes sequence of SEQ ID NO: 2.

11. The chimeric Class 2, Type V CRISPR of claim 10, wherein the substitution is A708K.

12. The chimeric Class 2, Type V CRISPR protein of claim 1, wherein the RuvC-I domain comprises a substitution at amino acid position I658 relative to the Planctomycetes sequence of SEQ ID NO: 2.

13. The chimeric Class 2, Type V CRISPR of claim 1, wherein the substitution is I658V.

14. The chimeric Class 2, Type V CRISPR protein of claim 1, comprising the sequence of SEQ ID NO: 416 or a sequence having at least 90%, at least 95%, at least 96%, at least 97%, at least 98%, or at least 99% identity thereto.

15. The chimeric Class 2, Type V CRISPR protein of claim 1, comprising the sequence of SEQ ID NO: 416.

16. The chimeric Class 2, Type V CRISPR protein of claim 1, comprising a substitution of G223S relative to the sequence of SEQ ID NO: 416.

17. The chimeric Class 2, Type V CRISPR protein of claim 16, comprising an insertion of an arginine amino acid (R) at position 26 relative to the sequence of SEQ ID NO: 416.

18. The chimeric Class 2, Type V CRISPR protein of claim 17, comprising a substitution of L169K relative to the sequence of SEQ ID NO: 416.

19. The chimeric Class 2, Type V CRISPR protein of claim 16, comprising a substitution of L169K relative to the sequence of SEQ ID NO: 416.

20. The chimeric Class 2, Type V CRISPR protein of claim 1, comprising a substitution of L169K and a substitution of G223S relative to the sequence of SEQ ID NO: 416.

21. The chimeric Class 2, Type V CRISPR protein of claim 1, comprising an insertion of R at position 26 and a substitution of G223S relative to the sequence of SEQ ID NO: 416.

22. The chimeric Class 2, Type V CRISPR protein of claim 1, comprising an insertion of R at position 26, a substitution of G223S, and a substitution of L169K relative to the sequence of SEQ ID NO: 416.

23. The chimeric Class 2, Type V CRISPR protein of claim 1, comprising one or more improved characteristics compared to the reference protein of SEQ ID NO: 2.

24. The chimeric Class 2, Type V CRISPR protein of claim 23, wherein the one or more improved characteristics comprise improved stability of a ribonuclear protein (RNP) complex comprising the Class 2, Type V CRISPR protein and a guide ribonucleic acid (gRNA), increased binding affinity between the Class 2, Type V CRISPR protein and gRNA, improved kinetics of RNP complex formation, higher percentage of cleavage-competent RNP, increased RNP binding affinity to a target nucleic acid, improved unwinding of the target nucleic acid, increased editing activity, increased editing efficiency, increased editing specificity for the target nucleic acid, decreased off-target editing or cleavage, increased nuclease activity of the Class 2, Type V CRISPR protein, increased target strand loading for double strand cleavage, decreased target strand loading for single strand nicking, increased binding of the non-target strand of DNA, or increased resistance to nuclease activity.

25. A chimeric Class 2, Type V CRISPR protein comprising the sequence of SEQ ID NO: 416, or a sequence having at least 90% identity thereto, wherein the Class 2, Type V CRISPR protein comprises a proline amino acid at position 793 relative to SEQ ID NO: 336, wherein the chimeric Class 2, Type V CRISPR protein comprises domains from two different Class 2, Type V CRISPR proteins, and wherein the chimeric Class 2, Type V CRISPR protein exhibits improved specificity relative to SEQ ID NO: 336.

26. The chimeric Class 2, Type V CRISPR protein of claim 25, comprising:
   a. an NTSB domain obtained from Deltaproteobacteria comprising the sequence of SEQ ID NO: 2335, or a sequence having at least 90%, at least 95%, at least 96%, at least 97%, at least 98% or at least 99% identity thereto;
   b. a helical 1-II domain obtained from Deltaproteobacteria comprising the sequence of SEQ ID NO: 2336, or a sequence having at least 90%, at least 95%, at least 96%, at least 97%, at least 98% or at least 99% identity thereto; and
   c. a RuvC-I domain obtained from Planctomycetes comprising the sequence of SEQ ID NO: 2352, or a sequence having at least 90%, at least 95%, at least 96%, at least 97%, at least 98% or at least 99% identity thereto.

27. The chimeric Class 2, Type V CRISPR protein of claim 25, comprising one or more improved characteristics compared to the reference protein of SEQ ID NO: 2.

28. A chimeric Class 2, Type V CRISPR protein comprising the sequence of SEQ ID NO: 416.

* * * * *

UNITED STATES PATENT AND TRADEMARK OFFICE
CERTIFICATE OF CORRECTION

PATENT NO. : 12,163,125 B2
APPLICATION NO. : 17/572208
DATED : December 10, 2024
INVENTOR(S) : Gayathri Vijayakumar et al.

Page 1 of 1

It is certified that error appears in the above-identified patent and that said Letters Patent is hereby corrected as shown below:

In the Claims

At Column 284, Claim number 26, Line number 11, please delete "b. a helical 1-II domain" and insert therein --b. a helical I-II domain--.

Signed and Sealed this
Twenty-fifth Day of March, 2025

Coke Morgan Stewart
*Acting Director of the United States Patent and Trademark Office*